United States Patent 7,745,391 (HUMAN THROMBOSPONDIN POLYPEPTIDE) - sequence listing, part 132

SEQ ID NO: 361061 - DNA, 3847 bp, Homo sapiens
cgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 361062 - DNA, 2577 bp, Homo sapiens
tagtagatcagggactttcattgacaatttttttttttttttgagacggagtctggctctgtcgcccaggctggagtgcagtggcacaatctcagctcactgcaagctccgcctccctggttcacgccattctcctgcctcagccttccgactgggattacaggcgtttgccaccatgcctagctaatttttgtatttttagtagagacgaggtttcaccatgttggccaggatggtctcgatctcttgacctcattatccctccaccttggcttcccaaagtgctgggattacaggcgtgagccactgagcccggcctagttaaataaaatttgataaacacgatggacttggttgtgtgttttctggtttttctgagatctagtttgaaaattctgacaactagcaaagtatatggaagcttcttcaggaaatagtaaacatatttctttttacagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 361063 - DNA, 1889 bp, Homo sapiens
ctcctacccacatacataaagaaactactagtgccacatcatcaccatatagagatacaatcaatatgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 361064 - DNA, 1783 bp, Homo sapiens
gtctgagtccacaaggaccagactgcacccggcacacaacacgtggaagctcaacaaagccaaagcatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 361065 - DNA, 1524 bp, Homo sapiens
gtaggaataggaacattattacagcttgaaaaagtgaaccatcatgttccatttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 361066 - DNA, 1597 bp, Homo sapiens
acttaagaaagaattcaaaataatttagggtagtatttaagaaactgcctataatgttattaaatttacaccaatttcaaggtttttggttgtttaaaaaaaaaattcaacaaactaaacttgaaataactttactgtttatagggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 361067 - DNA, 2116 bp, Homo sapiens
cgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttccgccgcttggttcatcgccaacatttcaacccatcgccactgcctcgaatctccaatccctatacacacctcccg

SEQ ID NO: 361068 - DNA, 2043 bp, Homo sapiens
  misc_feature (2036)..(2036): n is a, c, g, or t
cgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccagcccacgtagcggggncctctag

SEQ ID NO: 361069 - DNA, 254 bp, Homo sapiens
tgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgaggtaagtaagtttgagaaataaacatttttggggaacaaatagtaattctttttggatactctgttcatttataggaagataagataataaatattaactaaatttt

SEQ ID NO: 361070 - DNA, 952 bp, Homo sapiens
  misc_feature (713)..(713): n is a, c, g, or t
  misc_feature (722)..(722): n is a, c, g, or t
cgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaacctaactggacacagngtgttgatnttactccctcgcttgtgacatcgaggcaatgagagaactggctctccccagaagggcctgtgaaaccggtcagccacacacccaccaggagtttcctcacaaagagatggccctaaatgcgagacgaacatacctaagtggaccgggagggctggcggaggggcactcacatatgagcccacgaacgccagcgggtaaacctcaatcggggcgttggacctccaccacag

SEQ ID NO: 361071 - DNA, 4035 bp, Homo sapiens
cgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggaaacaacaacacaaatcataatcataccacatcaccaaccgataacaaacagaaagaggtg

SEQ ID NO: 361072 - DNA, 3251 bp, Homo sapiens
  misc_feature (8)..(8): n is a, c, g, or t
  misc_feature (10)..(10): n is a, c, g, or t
  misc_feature (12)..(12): n is a, c, g, or t
cccaattngncnttggccgggggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 361073 - DNA, 3851 bp, Homo sapiens
cgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 361074 - DNA, 3687 bp, Homo sapiens
cgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 361075 - DNA, 3649 bp, Homo sapiens
cgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 361076 - DNA, 2685 bp, Homo sapiens
catcagaatgtaagaaattaaaatgataaggatgtgaaccacaggcgaacagcgcggttggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 361077 - DNA, 2007 bp, Homo sapiens
agtgaacgcgtgagagagacatccacatatatcccaaataggaatgatagacttcacaagataacataaccttacaaatcaaatatgatcaaccagttaggaccagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 361078 - DNA, 3665 bp, Homo sapiens
cgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgtcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 361079 - DNA, 2464 bp, Homo sapiens
  misc_feature (2413)..(2413): n is a, c, g, or t
  misc_feature (2417)..(2417): n is a, c, g, or t
  misc_feature (2453)..(2453): n is a, c, g, or t
cgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagnaacntaccaggtttttccccccttttgggaaaaggggggnaaaaaaaaagg

SEQ ID NO: 361080 - DNA, 1742 bp, Homo sapiens
cgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacggtgagtagttatttttgttaatcccctaaattgtgtctgttgctacaagccccatttcaactaaacattactttacggtttttgttggtaatcatttggacattacaagctaatatatgtttatagttttcttaaatgtatttgcttaaatatttttgcccccgtaatttctta

SEQ ID NO: 361081 - DNA, 3128 bp, Homo sapiens
gaccctggagtttctgtccccaaacacaggcctcacgggattctttctgtcctcatgcactgggcagaggttccttaacttcctttgttgcacattgccattctctcacatcccgtgcggtcaggaagcccttcctgaactctgacttcagttcttgctgcggtttctgcccatttttttcatatcctctgacagctgcgaggtcatctctgctctggcttttctccaagcagaacaagtgggggctctggaaaggttaagggacctcagtggccaccattatactttgcatctttcctgagaagtgagagttgaaagggaagcaggaaggcccatggtcagattgaaggaaggactttttagtttcttttttttttttttgaaatggagtctcgctctgtcattcaggctggagtgcagtggtgcgatctcagctcactgcagcctccacttcctgggttcacatgattctcctgcctcagcctcccaagtagctgagactacaggcacatgccactacacccagctaacttttgtatttttagtagagacggggtttcaccatgttggccaggctggtctcaaactgctaacatcaagtgatctgctcccctcagcctcccaaagtgctgggattaccggtatgaaccaccacaacctgccaggaatttttagtttttagcttttgcaggagacttcaaggaaaggagacattcctctgtccaggaaacgggtaaggggaccatttctgcattgctggtttcccctcttggcagggtgggcatgaggcatcactgttcctgctccctcactcctgctcctcatgctcagcctgccagctcggcctcaactttgtgtgtctaaagtggaactgaatagtaggctgtgagaagataggaaagaggtagtgccaatctccttgcccagatcataaatccagactcagcagggtaaccacatgggcaagcacaaggtaggtgcttggggaaaggggaagtaattggcattctgtgtgataccaaggagaccatttggattttggcttctaccaaagagaatggagaattggttgacctaaatggaaccagtccctttaagtaaggggaggaaagggggtgctggaagatggccctcttcccaccacctagatcatagcttgaactgaagccaaggacagagtgctgcccccttcggcatttactgatgtgccctctttaaatcatgatgttatctaacccaaacccagacccaggacctagtcacagctccaacctacacttcctattaatcttaaaacaaagcaaaacaaaacaaaaagatatcagcattgtagcctccaatctgagcccatttcccttctctggctaccatacctccttctcctatatgataccattcactactttgttcaattatccagtctagacctgcatcttgaggccacacccagccttctcactccccacacccctctttcctctctcactgctccttcctggtctcttctcatctggccccacctctaaggagtcctcctgccttctgggttgccctggaaaacagactatcccccctcctagtgaagggagtgggtaggggtttcagccccaccctcaggaagatgcgtcttccctgtcctctgctctgtggtacttcctctctggctgatttagcaaacagcacctagacctggggccaggcctttggcagtgggacagatccagggataggctacaccaccctgccctgaccctgggattggcatcagcttccaaccagttcctgccaaagcttgtaagtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaacacaagtgagtggggtacat

SEQ ID NO: 361082 - DNA, 8312 bp, Homo sapiens
tccatacagggacaatatgtggctctggcctgtagtcgccatggcagccgtgtgctagatgccatctggagtggagcagccttgagggcccggaaggaaattgctgctgagcttggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatgtagcagcagtcaggctgggatcaagatgcctgggggacatcttgatcttggcctttcagggcaagtgggaggctagaaaggtggctaggaaagaacagcattcttcaggtaagggtatagacttgggatgtgaggcgttatgctgaaaggttctgtcacgaggggatcagaggacagtggggaaattgggtgggttatctagcctgtactgtctgcaggtcctgaaatttgatgctgtcatagtctttgcagtgggtcggttggaatgattctgggggcagaagctcagagccccttagtaggaatggaggcggcccttctgctgccactgctcagccccctccactgcatgacgaagggtggaggaaattcccagcaacatatggcccaggccttgcagcagtgtggaggtccaacgaaggagctccctgaatggcagagacaagaggaaatcagatgatttggaaaacttgggaggaagccatcaagctgggagatgaggactttccacaagcaagagctaactaggggtaggtgggtgcaagaggacgaattatggggactatccaactgtaggggatggggcagtatgacatgttgatttctgacctgagtactttctttgggccaagtccttgaaagtcacaactcatagagtagagcccgtagaatgtggctttgacattcaggctgccaaagaggtctcgagggttttgcttgtacacgtcaaaggtgaatcgggcgatgtccttgctgtgcttgggcctctcccgtcccaggccatatgacagcactccactctgtaggacacccttgtcagtgcagtagatcctcataccagacacccaccactaatctccatcagcactgggtcagaccctccctcgcttggactttctgtccactgtgtgacatccttgacaattccacaactcctcctgcacctggtccccaggatcagggttaagctagagaggaagcccgggaaagctctaaaggacaggcattggaagcagccccagtataggcctcttacccttgtagggctccagctctgaccagactgcaacaccatcaggcacgtgtcatcctccagcagctggaagaagtcctcactgtccactgcagttccatcctcctctagcaccagggttagcactccattcagcagtagggtctccaatgcctgcccaatggcaagaagcaagaagggcaggtcttatcccatgccccttccctctttagctgcccaacatccatcagttggctctagacattggtcgatgtcccactttgactttctggcactttgatacctcctaaaggttgcagctctccgtgttcttcagtttttgggggatcctagctagaggctgacctttttcctctttgctcctaccatgtcattggcatctccccttgctcccctccaagtcacttctggtttggaattggaaagcaagccaggttctcacgaagtccacccttctgtcttatctacaatgctgcacctcacttcccacaccctcaagagttctccagaagtgttttcagtaatagtgtttaacctttttgagtccttactctgtgccaggtatgaggactttacctacattatcctcttactcctttcaacaaccctaggaggtgatgtattattattgcctttttatagttgaagaaactgaggttttggtaggttgaacaacttcccaaggtttgacaggcaggaagtggcagaatcagaatttgaacttgatttgtcacacaaatcacctttccatactagcttctgaattccgtccctcgaactctccctatctcctgctaacccctgctcccatagaaaagctcactaggtggaaaatgaacaaattgaccagagctcattaggcccactccgctgcttttagccctcagagggaggggcagctgtgtgacttcagccctctgctccatcatcacaagttgccactgttgtggagccccttggctacccctgctataggaaccgaggaacttggcctacttactttggctagcagctcctggcgggtggcagctgtcaggcctttccggatggtccgcttgtgatcacagacacggaaaggtcgctggggtggtggagctgaggtccagaccctccgtccaaactccgagcttatattagatactgacctggtagttgagaagaaaagtcaagaaggggcgaggaggggcttggtgagtgtaaagggcatgatgagggtagagtggctagagggctagggagggagagatctaggtttatcgattagggatgagggagagaccatggagtgcaggtgggggcgggtggctcaggagcttgacaagcccactgtggagtggggagcaggagaggaaggggtactggttagtctcctaggggctgagtggagtattgttgccctgcctatatcccctaaaggtggagggtagagcggagggttagcagtcacctgagtaagtcactggggttcagagctgagaggtactccatggtggaccggagagttccttccctggaacttctgggctgggtggttctctcctgtgctggggctttagtggtgttttctgttacaaacctgggatctcagcccaggacaaggtgggaatgagtcaagcctggactctggcccccctgcctggccagtaagaagggcaaagtccaaggggagggatgagggaggggccagatggggtcctggaggaagaattgcctggcaaaagccattggagcttgtatgtgtgtctttggtgatgacatgtgttgtgagggtagatgggaaccatgtaaaaggatgaaatgtgacttctggtgtttttttatttctatggagggactttctggggacggtttctggctctcaggctctgagaagctgcagtttatgagtggctctgtgtgtgctgccacctactggagaagccataagctgcagctttaggaaaagggaacccggggcagagtgtggggaagtgggatggcagcatggcagggctttggaaaatgagaggtgagagtgtgtccaggaagggtgtaaggagaggatggatcctgatacatggattcaggatcattagggtcctgtctgggacactggccttcctgcttacctgctctttccttcctccttggtcggaggaggggctggctcactgctctggcttcattttccagagctgcctgctgcagtcacacttaggtcatcttctctcacttttctccttttgccgattagtggacgtgacagagatgtgaatggggcagggatgtcctttgatggcatcaagactttagcttctggtgcgctgtgtcccagctctgatttcagttgcagccgtgatggacagttgcatggaagctgagactctcactgacagtgaaaccctcaaatgaacacaatccctgctttcctgccaaggatccttgtagggtcccccagcttccccactttttttctgtgtcctgacaaagaaacacagagtaacttgattgccctgtgacctggccagttgcatttcccctgcaggcttgagcccaagccagagccttgaaaaggtattcaggttgttgcccaaaacactgaaaaaaactggccctggccctgaaccaaataccttgaaccctcgtaaactccataccctgacccccttgttttggatatacccaggtagaacaactctctctcactgtctgttgtgaggatacgctgtagcccactcattaagtacattctcctaataaatgctttggactgatcaccctgccagtcttttgtcttgggcaatctatacttttctcagaggttcccaaggcctactgaagggacttaacatactcttaatggctttcctctctcttgttttaccttatgccctcacttcctgagttaacctcccaaatacaggatcacctgtacccaagcccttagctcaagaatacaggatcacctgtacccaagcccttagctcaagctctgctttggaagaacccaaactaagacagtgctcctggtgccctccccaagcaacctcaagttctggctgttacttgagcagaggcctttcttttcccttcccccagctctatccatctgccaggcccccctcaaatctcttcatttccaagttttgcttgacttttccaagaggagagggctgcttcttagtatgtccctactcatcctttcctttcttgtcttgtatcctggtgcagcctggtaatggggcctcttcatggttgtgtgtcatgactccctaaccattatgcctccatgcatcccctgttcctcctggaacctagcaccatgccttacatggaaaagctgtcattgacagcccggtgagagccctgagggtggagtgactggggcagggcctgaggcaagaggtgggaggaggtaggaggccaggggctcagccggaccaggagactggaaacaggcaaggataaggcaggtgggggactgagttgtttgggtcacctctgcaggccagagagaccaggcaacatacacactgcagaaggtgggctgggaggattggggccagagctgggggagggatgagaacagaagcaggaccaggattcagcagagtcctcctatttccttccaccaccagggaatcttactgccccacttcagcttgtgctgtttcctggcaaggcaggctctcacatgcctggacgcctgggtgcgttggtgatgggaaggagcagggtgagggaggggccccaggagaggcccaggatgagcctcatcttgtccctccccattcttgtcttaccctctgcaaatgtgataggcacaggacaggagtaggcacctcgcctactgctgcttaacctttcagcttctccaggcccccaatcctgcttgctcccagcttggtaagtagatctgtgcacgtccctttacaccccaccatccagttttgcccagatgtgctagaatggggctggacaaagaaggaggggccagactagaggagtggtggtagagatagtgacagcctggggtgaggactttatgcctgtttaccactgagctctgggaaggaggccaggagtggggcaggtcaactgactgggagcaggggatctgggttccaagaaggagttgtgtttgaggtggggtctgggtcctcgtggaagtcaggactcccaggcagaaaagaggcaggctgcagggaagtaaggaggaggcatggcaccttctcatcgggcatcacaggtggggttttgccccacccctgaacgccctctgtggcgccttccacccacctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaacacaagtgagtggggtacat

SEQ ID NO: 361083 - DNA, 8131 bp, Homo sapiens
tccatacagggacaatatgtggctctggcctgtagtcgccatggcagccgtgtgctagatgccatctggagtggagcagccttgagggcccggaaggaaattgctgctgagcttggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatgtagcagcagtcaggctgggatcaagatgcctgggggacatcttgatcttggcctttcagggcaagtgggaggctagaaaggtggctaggaaagaacagcattcttcaggtaagggtatagacttgggatgtgaggcgttatgctgaaaggttctgtcacgaggggatcagaggacagtggggaaattgggtgggttatctagcctgtactgtctgcaggtcctgaaatttgatgctgtcatagtctttgcagtgggtcggttggaatgattctgggggcagaagctcagagccccttagtaggaatggaggcggcccttctgctgccactgctcagccccctccactgcatgacgaagggtggaggaaattcccagcaacatatggcccaggccttgcagcagtgtggaggtccaacgaaggagctccctgagtactttctttgggccaagtccttgaaagtcacaactcatagagtagagcccgtagaatgtggctttgacattcaggctgccaaagaggtctcgagggttttgcttgtacacgtcaaaggtgaatcgggcgatgtccttgctgtgcttgggcctctcccgtcccaggccatatgacagcactccactctgtaggacacccttgtcagtgcagtagatcctcataccagacacccaccactaatctccatcagcactgggtcagaccctccctcgcttggactttctgtccactgtgtgacatccttgacaattccacaactcctcctgcacctggtccccaggatcagggttaagctagagaggaagcccgggaaagctctaaaggacaggcattggaagcagccccagtataggcctcttacccttgtagggctccagctctgaccagactgcaacaccatcaggcacgtgtcatcctccagcagctggaagaagtcctcactgtccactgcagttccatcctcctctagcaccagggttagcactccattcagcagtagggtctccaatgcctgcccaatggcaagaagcaagaagggcaggtcttatcccatgccccttccctctttagctgcccaacatccatcagttggctctagacattggtcgatgtcccactttgactttctggcactttgatacctcctaaaggttgcagctctccgtgttcttcagtttttgggggatcctagctagaggctgacctttttcctctttgctcctaccatgtcattggcatctccccttgctcccctccaagtcacttctggtttggaattggaaagcaagccaggttctcacgaagtccacccttctgtcttatctacaatgctgcacctcacttcccacaccctcaagagttctccagaagtgttttcagtaatagtgtttaacctttttgagtccttactctgtgccaggtatgaggactttacctacattatcctcttactcctttcaacaaccctaggaggtgatgtattattattgcctttttatagttgaagaaactgaggttttggtaggttgaacaacttcccaaggtttgacaggcaggaagtggcagaatcagaatttgaacttgatttgtcacacaaatcacctttccatactagcttctgaattccgtccctcgaactctccctatctcctgctaacccctgctcccatagaaaagctcactaggtggaaaatgaacaaattgaccagagctcattaggcccactccgctgcttttagccctcagagggaggggcagctgtgtgacttcagccctctgctccatcatcacaagttgccactgttgtggagccccttggctacccctgctataggaaccgaggaacttggcctacttactttggctagcagctcctggcgggtggcagctgtcaggcctttccggatggtccgcttgtgatcacagacacggaaaggtcgctggggtggtggagctgaggtccagaccctccgtccaaactccgagcttatattagatactgacctggtagttgagaagaaaagtcaagaaggggcgaggaggggcttggtgagtgtaaagggcatgatgagggtagagtggctagagggctagggagggagagatctaggtttatcgattagggatgagggagagaccatggagtgcaggtgggggcgggtggctcaggagcttgacaagcccactgtggagtggggagcaggagaggaaggggtactggttagtctcctaggggctgagtggagtattgttgccctgcctatatcccctaaaggtggagggtagagcggagggttagcagtcacctgagtaagtcactggggttcagagctgagaggtactccatggtggaccggagagttccttccctggaacttctgggctgggtggttctctcctgtgctggggctttagtggtgttttctgttacaaacctgggatctcagcccaggacaaggtgggaatgagtcaagcctggactctggcccccctgcctggccagtaagaagggcaaagtccaaggggagggatgagggaggggccagatggggtcctggaggaagaattgcctggcaaaagccattggagcttgtatgtgtgtctttggtgatgacatgtgttgtgagggtagatgggaaccatgtaaaaggatgaaatgtgacttctggtgtttttttatttctatggagggactttctggggacggtttctggctctcaggctctgagaagctgcagtttatgagtggctctgtgtgtgctgccacctactggagaagccataagctgcagctttaggaaaagggaacccggggcagagtgtggggaagtgggatggcagcatggcagggctttggaaaatgagaggtgagagtgtgtccaggaagggtgtaaggagaggatggatcctgatacatggattcaggatcattagggtcctgtctgggacactggccttcctgcttacctgctctttccttcctccttggtcggaggaggggctggctcactgctctggcttcattttccagagctgcctgctgcagtcacacttaggtcatcttctctcacttttctccttttgccgattagtggacgtgacagagatgtgaatggggcagggatgtcctttgatggcatcaagactttagcttctggtgcgctgtgtcccagctctgatttcagttgcagccgtgatggacagttgcatggaagctgagactctcactgacagtgaaaccctcaaatgaacacaatccctgctttcctgccaaggatccttgtagggtcccccagcttccccactttttttctgtgtcctgacaaagaaacacagagtaacttgattgccctgtgacctggccagttgcatttcccctgcaggcttgagcccaagccagagccttgaaaaggtattcaggttgttgcccaaaacactgaaaaaaactggccctggccctgaaccaaataccttgaaccctcgtaaactccataccctgacccccttgttttggatatacccaggtagaacaactctctctcactgtctgttgtgaggatacgctgtagcccactcattaagtacattctcctaataaatgctttggactgatcaccctgccagtcttttgtcttgggcaatctatacttttctcagaggttcccaaggcctactgaagggacttaacatactcttaatggctttcctctctcttgttttaccttatgccctcacttcctgagttaacctcccaaatacaggatcacctgtacccaagcccttagctcaagaatacaggatcacctgtacccaagcccttagctcaagctctgctttggaagaacccaaactaagacagtgctcctggtgccctccccaagcaacctcaagttctggctgttacttgagcagaggcctttcttttcccttcccccagctctatccatctgccaggcccccctcaaatctcttcatttccaagttttgcttgacttttccaagaggagagggctgcttcttagtatgtccctactcatcctttcctttcttgtcttgtatcctggtgcagcctggtaatggggcctcttcatggttgtgtgtcatgactccctaaccattatgcctccatgcatcccctgttcctcctggaacctagcaccatgccttacatggaaaagctgtcattgacagcccggtgagagccctgagggtggagtgactggggcagggcctgaggcaagaggtgggaggaggtaggaggccaggggctcagccggaccaggagactggaaacaggcaaggataaggcaggtgggggactgagttgtttgggtcacctctgcaggccagagagaccaggcaacatacacactgcagaaggtgggctgggaggattggggccagagctgggggagggatgagaacagaagcaggaccaggattcagcagagtcctcctatttccttccaccaccagggaatcttactgccccacttcagcttgtgctgtttcctggcaaggcaggctctcacatgcctggacgcctgggtgcgttggtgatgggaaggagcagggtgagggaggggccccaggagaggcccaggatgagcctcatcttgtccctccccattcttgtcttaccctctgcaaatgtgataggcacaggacaggagtaggcacctcgcctactgctgcttaacctttcagcttctccaggcccccaatcctgcttgctcccagcttggtaagtagatctgtgcacgtccctttacaccccaccatccagttttgcccagatgtgctagaatggggctggacaaagaaggaggggccagactagaggagtggtggtagagatagtgacagcctggggtgaggactttatgcctgtttaccactgagctctgggaaggaggccaggagtggggcaggtcaactgactgggagcaggggatctgggttccaagaaggagttgtgtttgaggtggggtctgggtcctcgtggaagtcaggactcccaggcagaaaagaggcaggctgcagggaagtaaggaggaggcatggcaccttctcatcgggcatcacaggtggggttttgccccacccctgaacgccctctgtggcgccttccacccacctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaacacaagtgagtggggtacat

SEQ ID NO: 361084 - DNA, 7895 bp, Homo sapiens
tccatacagggacaatatgtggctctggcctgtagtcgccatggcagccgtgtgctagatgccatctggagtggagcagccttgagggcccggaaggaaattgctgctgagcttggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatgtagcagcagtcaggctgggatcaagatgcctgggggacatcttgatcttggcctttcagggcaagtgggaggctagaaaggtggctaggaaagaacagcattcttcaggtaagggtatagacttgggatgtgaggcgttatgctgaaaggttctgtcacgaggggatcagaggacagtggggaaattgggtgggttatctagcctgtactgtctgcaggtcctgaaatttgatgctgtcatagtctttgcagtgggtcggttggaatgattctgggggcagaagctcagagccccttagtaggaatggaggcggcccttctgctgccactgctcagccccctccactgcatgacgaagggtggaggaaattcccagcaacatatggcccaggccttgcagcagtgtggaggtccaacgaaggagctccctgagtactttctttgggccaagtccttgaaagtcacaactcatagagtagagcccgtagaatgtggctttgacattcaggctgccaaagaggtctcgagggttttgcttgtacacgtcaaaggtgaatcgggcgatgtccttgctgtgcttgggcctctcccgtcccaggccatatgacagcactccactccttgtagggctccagctctgaccagactgcaacaccatcaggcacgtgtcatcctccagcagctggaagaagtcctcactgtccactgcagttccatcctcctctagcaccagggttagcactccattcagcagtagggtctccaatgcctgcccaatggcaagaagcaagaagggcaggtcttatcccatgccccttccctctttagctgcccaacatccatcagttggctctagacattggtcgatgtcccactttgactttctggcactttgatacctcctaaaggttgcagctctccgtgttcttcagtttttgggggatcctagctagaggctgacctttttcctctttgctcctaccatgtcattggcatctccccttgctcccctccaagtcacttctggtttggaattggaaagcaagccaggttctcacgaagtccacccttctgtcttatctacaatgctgcacctcacttcccacaccctcaagagttctccagaagtgttttcagtaatagtgtttaacctttttgagtccttactctgtgccaggtatgaggactttacctacattatcctcttactcctttcaacaaccctaggaggtgatgtattattattgcctttttatagttgaagaaactgaggttttggtaggttgaacaacttcccaaggtttgacaggcaggaagtggcagaatcagaatttgaacttgatttgtcacacaaatcacctttccatactagcttctgaattccgtccctcgaactctccctatctcctgctaacccctgctcccatagaaaagctcactaggtggaaaatgaacaaattgaccagagctcattaggcccactccgctgcttttagccctcagagggaggggcagctgtgtgacttcagccctctgctccatcatcacaagttgccactgttgtggagccccttggctacccctgctataggaaccgaggaacttggcctacttactttggctagcagctcctggcgggtggcagctgtcaggcctttccggatggtccgcttgtgatcacagacacggaaaggtcgctggggtggtggagctgaggtccagaccctccgtccaaactccgagcttatattagatactgacctggtagttgagaagaaaagtcaagaaggggcgaggaggggcttggtgagtgtaaagggcatgatgagggtagagtggctagagggctagggagggagagatctaggtttatcgattagggatgagggagagaccatggagtgcaggtgggggcgggtggctcaggagcttgacaagcccactgtggagtggggagcaggagaggaaggggtactggttagtctcctaggggctgagtggagtattgttgccctgcctatatcccctaaaggtggagggtagagcggagggttagcagtcacctgagtaagtcactggggttcagagctgagaggtactccatggtggaccggagagttccttccctggaacttctgggctgggtggttctctcctgtgctggggctttagtggtgttttctgttacaaacctgggatctcagcccaggacaaggtgggaatgagtcaagcctggactctggcccccctgcctggccagtaagaagggcaaagtccaaggggagggatgagggaggggccagatggggtcctggaggaagaattgcctggcaaaagccattggagcttgtatgtgtgtctttggtgatgacatgtgttgtgagggtagatgggaaccatgtaaaaggatgaaatgtgacttctggtgtttttttatttctatggagggactttctggggacggtttctggctctcaggctctgagaagctgcagtttatgagtggctctgtgtgtgctgccacctactggagaagccataagctgcagctttaggaaaagggaacccggggcagagtgtggggaagtgggatggcagcatggcagggctttggaaaatgagaggtgagagtgtgtccaggaagggtgtaaggagaggatggatcctgatacatggattcaggatcattagggtcctgtctgggacactggccttcctgcttacctgctctttccttcctccttggtcggaggaggggctggctcactgctctggcttcattttccagagctgcctgctgcagtcacacttaggtcatcttctctcacttttctccttttgccgattagtggacgtgacagagatgtgaatggggcagggatgtcctttgatggcatcaagactttagcttctggtgcgctgtgtcccagctctgatttcagttgcagccgtgatggacagttgcatggaagctgagactctcactgacagtgaaaccctcaaatgaacacaatccctgctttcctgccaaggatccttgtagggtcccccagcttccccactttttttctgtgtcctgacaaagaaacacagagtaacttgattgccctgtgacctggccagttgcatttcccctgcaggcttgagcccaagccagagccttgaaaaggtattcaggttgttgcccaaaacactgaaaaaaactggccctggccctgaaccaaataccttgaaccctcgtaaactccataccctgacccccttgttttggatatacccaggtagaacaactctctctcactgtctgttgtgaggatacgctgtagcccactcattaagtacattctcctaataaatgctttggactgatcaccctgccagtcttttgtcttgggcaatctatacttttctcagaggttcccaaggcctactgaagggacttaacatactcttaatggctttcctctctcttgttttaccttatgccctcacttcctgagttaacctcccaaatacaggatcacctgtacccaagcccttagctcaagaatacaggatcacctgtacccaagcccttagctcaagctctgctttggaagaacccaaactaagacagtgctcctggtgccctccccaagcaacctcaagttctggctgttacttgagcagaggcctttcttttcccttcccccagctctatccatctgccaggcccccctcaaatctcttcatttccaagttttgcttgacttttccaagaggagagggctgcttcttagtatgtccctactcatcctttcctttcttgtcttgtatcctggtgcagcctggtaatggggcctcttcatggttgtgtgtcatgactccctaaccattatgcctccatgcatcccctgttcctcctggaacctagcaccatgccttacatggaaaagctgtcattgacagcccggtgagagccctgagggtggagtgactggggcagggcctgaggcaagaggtgggaggaggtaggaggccaggggctcagccggaccaggagactggaaacaggcaaggataaggcaggtgggggactgagttgtttgggtcacctctgcaggccagagagaccaggcaacatacacactgcagaaggtgggctgggaggattggggccagagctgggggagggatgagaacagaagcaggaccaggattcagcagagtcctcctatttccttccaccaccagggaatcttactgccccacttcagcttgtgctgtttcctggcaaggcaggctctcacatgcctggacgcctgggtgcgttggtgatgggaaggagcagggtgagggaggggccccaggagaggcccaggatgagcctcatcttgtccctccccattcttgtcttaccctctgcaaatgtgataggcacaggacaggagtaggcacctcgcctactgctgcttaacctttcagcttctccaggcccccaatcctgcttgctcccagcttggtaagtagatctgtgcacgtccctttacaccccaccatccagttttgcccagatgtgctagaatggggctggacaaagaaggaggggccagactagaggagtggtggtagagatagtgacagcctggggtgaggactttatgcctgtttaccactgagctctgggaaggaggccaggagtggggcaggtcaactgactgggagcaggggatctgggttccaagaaggagttgtgtttgaggtggggtctgggtcctcgtggaagtcaggactcccaggcagaaaagaggcaggctgcagggaagtaaggaggaggcatggcaccttctcatcgggcatcacaggtggggttttgccccacccctgaacgccctctgtggcgccttccacccacctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaacacaagtgagtggggtacat

SEQ ID NO: 361085 - DNA, 7969 bp, Homo sapiens
tccatacagggacaatatgtggctctggcctgtagtcgccatggcagccgtgtgctagatgccatctggagtggagcagccttgagggcccggaaggaaattgctgctgagcttggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatgtagcagcagtcaggctgggatcaagatgcctgggggacatcttgatcttggcctttcagggcaagtgggaggctagaaaggtggctaggaaagaacagcattcttcaggtaagggtatagacttgggatgtgaggcgttatgctgaaaggttctgtcacgaggggatcagaggacagtggggaaattgggtgggttatctagcctgtactgtctgcaggtcctgaaatttgatgctgtcatagtctttgcagtgggtcggttggaatgattctgggggcagaagctcagagccccttagtaggaatggaggcggcccttctgctgccactgctcagccccctccactgcatgacgaagggtggaggaaattcccagcaacatatggcccaggccttgcagcagtgtggaggtccaacgaaggagctccctgaatggcagagacaagaggaaatcagatgatttggaaaacttgggaggaagccatcaagctgggagatgaggactttccacaagcaagagctaactaggggtaggtgggtgcaagaggacgaattatggggactatccaactgtaggggatggggcagtatgacatgttgatttctgacctgagtactttctttgggccaagtccttgaaagtcacaactcatagagtagagcccgtagaatgtggctttgacattcaggctgccaaagaggtctcgagggttttgcttgtacacgtcaaaggtgaatcgggcgatgtccttgctgtgcttgggcctctcccgtcccaggccatatgacagcactccactctgtaggacacccttgtcagtgcagtagatcctcataccagacacccaccactaatctccatcagcactgggtcagaccctccctcgcttggactttctgtccactgtgtgacatccttgacaattccacaactcctcctgcacctggtccccaggatcagggttaagctagagaggaagcccgggaaagctctaaaggacaggcattggaagcagccccagtataggcctcttacccttgtagggctccagctctgaccagactgcaacaccatcaggcacgtgtcatcctccagcagctggaagaagtcctcactgtccactgcagttccatcctcctctagcaccagggttagcactccattcagcagtagggtctccaatgcctgcccaatggcaagaagcaagaagggcaggtcttatcccatgccccttccctctttagctgcccaacatccatcagttggctctagacattggtcgatgtcccactttgactttctggcactttgatacctcctaaaggttgcagctctccgtgttcttcagtttttgggggatcctagctagaggctgacctttttcctctttgctcctaccatgtcattggcatctccccttgctcccctccaagtcacttctggtttggaattggaaagcaagccaggttctcacgaagtccacccttctgtcttatctacaatgctgcacctcacttcccacaccctcaagagttctccagaagtgttttcagtaatagtgtttaacctttttgagtccttactctgtgccaggtatgaggactttacctacattatcctcttactcctttcaacaaccctaggaggtgatgtattattattgcctttttatagttgaagaaactgaggttttggtaggttgaacaacttcccaaggtttgacaggcaggaagtggcagaatcagaatttgaacttgatttgtcacacaaatcacctttccatactagcttctgaattccgtccctcgaactctccctatctcctgctaacccctgctcccatagaaaagctcactaggtggaaaatgaacaaattgaccagagctcattaggcccactccgctgcttttagccctcagagggaggggcagctgtgtgacttcagccctctgctccatcatcacaagttgccactgttgtggagccccttggctacccctgctataggaaccgaggaacttggcctacttactttggctagcagctcctggcgggtggcagctgtcaggcctttccggatggtccgcttgtgatcacagacacggaaaggtcgctggggtggtggagctgaggtccagaccctccgtccaaactccgagcttatattagatactgacctggtagttgagaagaaaagtcaagaaggggcgaggaggggcttggtgagtgtaaagggcatgatgagggtagagtggctagagggctagggagggagagatctaggtttatcgattagggatgagggagagaccatggagtgcaggtgggggcgggtggctcaggagcttgacaagcccactgtggagtggggagcaggagaggaaggggtactggttagtctcctaggggctgagtggagtattgttgccctgcctatatcccctaaaggtggagggtagagcggagggttagcagtcacctgagtaagtcactggggttcagagctgagaggtactccatggtggaccggagagttccttccctggaacttctgggctgggtggttctctcctgtgctggggctttagtggtgttttctgttacaaacctgggatctcagcccaggacaaggtgggaatgagtcaagcctggactctggcccccctgcctggccagtaagaagggcaaagtccaaggggagggatgagggaggggccagatggggtcctggaggaagaattgcctggcaaaagccattggagcttgtatgtgtgtctttggtgatgacatgtgttgtgagggtagatgggaaccatgtaaaaggatgaaatgtgacttctggtgtttttttatttctatggagggactttctggggacggtttctggctctcaggctctgagaagctgcagtttatgagtggctctgtgtgtgctgccacctactggagaagccataagctgcagctttaggaaaagggaacccggggcagagtgtggggaagtgggatggcagcatggcagggctttggaaaatgagaggtgagagtgtgtccaggaagggtgtaaggagaggatggatcctgatacatggattcaggatcattagggtcctgtctgggacactggccttcctgcttacctgctctttccttcctccttggtcggaggaggggctggctcactgctctggcttcattttccagagctgcctgctgcagtcacacttaggtcatcttctctcacttttctccttttgccgattagtggacgtgacagagatgtgaatggggcagggatgtcctttgatggcatcaagactttagcttctggtgcgctgtgtcccagctctgatttcagttgcagccgtgatggacagttgcatggaagctgagactctcactgacagtgaaaccctcaaatgaacacaatccctgctttcctgccaaggatccttgtagggtcccccagcttccccactttttttctgtgtcctgacaaagaaacacagagtaacttgattgccctgtgacctggccagttgcatttcccctgcaggcttgagcccaagccagagccttgaaaaggtattcaggttgttgcccaaaacactgaaaaaaactggccctggccctgaaccaaataccttgaaccctcgtaaactccataccctgacccccttgttttggatatacccaggtagaacaactctctctcactgtctgttgtgaggatacgctgtagcccactcattaagtacattctcctaataaatgctttggactgatcaccctgccagtcttttgtcttgggcaatctatacttttctcagaggttcccaaggcctactgaagggacttaacatactcttaatggctttcctctctcttgttttaccttatgccctcacttcctgagttaacctcccaaatacaggatcacctgtacccaagcccttagctcaagaatacaggatcacctgtacccaagcccttagctcaagctctgctttggaagaacccaaactaagacagtgctcctggtgccctccccaagcaacctcaagttctggctgttacttgagcagaggcctttcttttcccttcccccagctctatccatctgccaggcccccctcaaatctcttcatttccaagttttgcttgacttttccaagaggagagggctgcttcttagtatgtccctactcatcctttcctttcttgtcttgtatcctggtgcagcctggtaatggggcctcttcatggttgtgtgtcatgactccctaaccattatgcctccatgcatcccctgttcctcctggaacctagcaccatgccttacatggaaaagctgtcattgacagcccggtgagagccctgagggtggagtgactggggcagggcctgaggcaagaggtgggaggaggtaggaggccaggggctcagccggaccaggagactggaaacaggcaaggataaggcaggtgggggactgagttgtttgggtcacctctgcaggccagagagaccaggcaacatacacactgcagaaggtgggctgggaggattggggccagagctgggggagggatgagaacagaagcaggaccaggattcagcagagtcctcctatttccttccaccaccagggaatcttactgccccacttcagcttgtgctgtttcctggcaaggcaggctctcacatgcctggacgcctgggtgcgttggtgatgggaaggagcagggtgagggaggggccccaggagaggcccaggatgagcctcatcttgtccctccccattcttgtcttaccctctgcaaatgtgataggcacaggacaggagtaggcacctcgcctactgctgcttaacctttcagcttctccaggcccccaatcctgcttgctcccagcttggtggggttttgccccacccctgaacgccctctgtggcgccttccacccacctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaacacaagtgagtggggtacat

SEQ ID NO: 361086 - DNA, 6494 bp, Homo sapiens
tccatacagggacaatatgtggctctggcctgtagtcgccatggcagccgtgtgctagatgccatctggagtggagcagccttgagggcccggaaggaaattgctgctgagcttggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatgtagcagcagtcaggctgggatcaagatgcctgggggacatcttgatcttggcctttcagggcaagtgggaggctagaaaggtggctaggaaagaacagcattcttcaggtaagggtatagacttgggatgtgaggcgttatgctgaaaggttctgtcacgaggggatcagaggacagtggggaaattgggtgggttatctagcctgtactgtctgcaggtcctgaaatttgatgctgtcatagtctttgcagtgggtcggttggaatgattctgggggcagaagctcagagccccttagtaggaatggaggcggcccttctgctgccactgctcagccccctccactgcatgacgaagggtggaggaaattcccagcaacatatggcccaggccttgcagcagtgtggaggtccaacgaaggagctccctgaatggcagagacaagaggaaatcagatgatttggaaaacttgggaggaagccatcaagctgggagatgaggactttccacaagcaagagctaactaggggtaggtgggtgcaagaggacgaattatggggactatccaactgtaggggatggggcagtatgacatgttgatttctgacctgagtactttctttgggccaagtccttgaaagtcacaactcatagagtagagcccgtagaatgtggctttgacattcaggctgccaaagaggtctcgagggttttgcttgtacacgtcaaaggtgaatcgggcgatgtccttgctgtgcttgggcctctcccgtcccaggccatatgacagcactccactctgtaggacacccttgtcagtgcagtagatcctcataccagacacccaccactaatctccatcagcactgggtcagaccctccctcgcttggactttctgtccactgtgtgacatccttgacaattccacaactcctcctgcacctggtccccaggatcagggttaagctagagaggaagcccgggaaagctctaaaggacaggcattggaagcagccccagtataggcctcttacccttgtagggctccagctctgaccagactgcaacaccatcaggcacgtgtcatcctccagcagctggaagaagtcctcactgtccactgcagttccatcctcctctagcaccagggttagcactccattcagcagtagggtctccaatgcctgcccaatggcaagaagcaagaagggcaggtcttatcccatgccccttccctctttagctgcccaacatccatcagttggctctagacattggtcgatgtcccactttgactttctggcactttgatacctcctaaaggttgcagctctccgtgttcttcagtttttgggggatcctagctagaggctgacctttttcctctttgctcctaccatgtcattggcatctccccttgctcccctccaagtcacttctggtttggaattggaaagcaagccaggttctcacgaagtccacccttctgtcttatctacaatgctgcacctcacttcccacaccctcaagagttctccagaagtgttttcagtaatagtgtttaacctttttgagtccttactctgtgccaggtatgaggactttacctacattatcctcttactcctttcaacaaccctaggaggtgatgtattattattgcctttttatagttgaagaaactgaggttttggtaggttgaacaacttcccaaggtttgacaggcaggaagtggcagaatcagaatttgaacttgatttgtcacacaaatcacctttccatactagcttctgaattccgtccctcgaactctccctatctcctgctaacccctgctcccatagaaaagctcactaggtggaaaatgaacaaattgaccagagctcattaggcccactccgctgcttttagccctcagagggaggggcagctgtgtgacttcagccctctgctccatcatcacaagttgccactgttgtggagccccttggctacccctgctataggaaccgaggaacttggcctacttactttggctagcagctcctggcgggtggcagctgtcaggcctttccggatggtccgcttgtgatcacagacacggaaaggtcgctggggtggtggagctgaggtccagaccctccgtccaaactccgagcttatattagatactgacctggtagttgagaagaaaagtcaagaaggggcgaggaggggcttggtgagtgtaaagggcatgatgagggtagagtggctagagggctagggagggagagatctaggtttatcgattagggatgagggagagaccatggagtgcaggtgggggcgggtggctcaggagcttgacaagcccactgtggagtggggagcaggagaggaaggggtactggttagtctcctaggggctgagtggagtattgttgccctgcctatatcccctaaaggtggagggtagagcggagggttagcagtcacctgagtaagtcactggggttcagagctgagaggtactccatggtggaccggagagttccttccctggaacttctgggctgggtggttctctcctgtgctggggctttagtggtgttttctgttacaaacctgggatctcagcccaggacaaggtgggaatgagtcaagcctggactctggcccccctgcctggccagtaagaagggcaaagtccaaggggagggatgagggaggggccagatggggtcctggaggaagaattgcctggcaaaagccattggagcttgtatgtgtgtctttggtgatgacatgtgttgtgagggtagatgggaaccatgtaaaaggatgaaatgtgacttctggtgtttttttatttctatggagggactttctggggacggtttctggctctcaggctctgagaagctgcagtttatgagtggctctgtgtgtgctgccacctactggagaagccataagctgcagctttaggaaaagggaacccggggcagagtgtggggaagtgggatggcagcatggcagggctttggaaaatgagaggtgagagtgtgtccaggaagggtgtaaggagaggatggatcctgatacatggattcaggatcattagggtcctgtctgggacactggccttcctgcttacctgctctttccttcctccttggtcggaggaggggctggctcactgctctggcttcattttccagagctgcctgctgcagtcacacttaggtcatcttctctcacttttctccttttgccgattagtggacgtgacagagatgtgaatggggcagggatgtcctttgatggcatcaagactttagcttctggtgcgctgtgtcccagctctgatttcagttgcagccgtgatggacagttgcatggaagctgagactctcactgacagtgaaaccctcaaatgaacacaatccctgctttcctgccaaggatccttgtagggtcccccagcttccccactttttttctgtgtcctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaacacaagtgagtggggtacat

SEQ ID NO: 361087 - DNA, 6990 bp, Homo sapiens
tccatacagggacaatatgtggctctggcctgtagtcgccatggcagccgtgtgctagatgccatctggagtggagcagccttgagggcccggaaggaaattgctgctgagcttggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatgtagcagcagtcaggctgggatcaagatgcctgggggacatcttgatcttggcctttcagggcaagtgggaggctagaaaggtggctaggaaagaacagcattcttcaggtaagggtatagacttgggatgtgaggcgttatgctgaaaggttctgtcacgaggggatcagaggacagtggggaaattgggtgggttatctagcctgtactgtctgcaggtcctgaaatttgatgctgtcatagtctttgcagtgggtcggttggaatgattctgggggcagaagctcagagccccttagtaggaatggaggcggcccttctgctgccactgctcagccccctccactgcatgacgaagggtggaggaaattcccagcaacatatggcccaggccttgcagcagtgtggaggtccaacgaaggagctccctgaatggcagagacaagaggaaatcagatgatttggaaaacttgggaggaagccatcaagctgggagatgaggactttccacaagcaagagctaactaggggtaggtgggtgcaagaggacgaattatggggactatccaactgtaggggatggggcagtatgacatgttgatttctgacctgagtactttctttgggccaagtccttgaaagtcacaactcatagagtagagcccgtagaatgtggctttgacattcaggctgccaaagaggtctcgagggttttgcttgtacacgtcaaaggtgaatcgggcgatgtccttgctgtgcttgggcctctcccgtcccaggccatatgacagcactccactctgtaggacacccttgtcagtgcagtagatcctcataccagacacccaccactaatctccatcagcactgggtcagaccctccctcgcttggactttctgtccactgtgtgacatccttgacaattccacaactcctcctgcacctggtccccaggatcagggttaagctagagaggaagcccgggaaagctctaaaggacaggcattggaagcagccccagtataggcctcttacccttgtagggctccagctctgaccagactgcaacaccatcaggcacgtgtcatcctccagcagctggaagaagtcctcactgtccactgcagttccatcctcctctagcaccagggttagcactccattcagcagtagggtctccaatgcctgcccaatggcaagaagcaagaagggcaggtcttatcccatgccccttccctctttagctgcccaacatccatcagttggctctagacattggtcgatgtcccactttgactttctggcactttgatacctcctaaaggttgcagctctccgtgttcttcagtttttgggggatcctagctagaggctgacctttttcctctttgctcctaccatgtcattggcatctccccttgctcccctccaagtcacttctggtttggaattggaaagcaagccaggttctcacgaagtccacccttctgtcttatctacaatgctgcacctcacttcccacaccctcaagagttctccagaagtgttttcagtaatagtgtttaacctttttgagtccttactctgtgccaggtatgaggactttacctacattatcctcttactcctttcaacaaccctaggaggtgatgtattattattgcctttttatagttgaagaaactgaggttttggtaggttgaacaacttcccaaggtttgacaggcaggaagtggcagaatcagaatttgaacttgatttgtcacacaaatcacctttccatactagcttctgaattccgtccctcgaactctccctatctcctgctaacccctgctcccatagaaaagctcactaggtggaaaatgaacaaattgaccagagctcattaggcccactccgctgcttttagccctcagagggaggggcagctgtgtgacttcagccctctgctccatcatcacaagttgccactgttgtggagccccttggctacccctgctataggaaccgaggaacttggcctacttactttggctagcagctcctggcgggtggcagctgtcaggcctttccggatggtccgcttgtgatcacagacacggaaaggtcgctggggtggtggagctgaggtccagaccctccgtccaaactccgagcttatattagatactgacctggtagttgagaagaaaagtcaagaaggggcgaggaggggcttggtgagtgtaaagggcatgatgagggtagagtggctagagggctagggagggagagatctaggtttatcgattagggatgagggagagaccatggagtgcaggtgggggcgggtggctcaggagcttgacaagcccactgtggagtggggagcaggagaggaaggggtactggttagtctcctaggggctgagtggagtattgttgccctgcctatatcccctaaaggtggagggtagagcggagggttagcagtcacctgagtaagtcactggggttcagagctgagaggtactccatggtggaccggagagttccttccctggaacttctgggctgggtggttctctcctgtgctggggctttagtggtgttttctgttacaaacctgggatctcagcccaggacaaggtgggaatgagtcaagcctggactctggcccccctgcctggccagtaagaagggcaaagtccaaggggagggatgagggaggggccagatggggtcctggaggaagaattgcctggcaaaagccattggagcttgtatgtgtgtctttggtgatgacatgtgttgtgagggtagatgggaaccatgtaaaaggatgaaatgtgacttctggtgtttttttatttctatggagggactttctggggacggtttctggctctcaggctctgagaagctgcagtttatgagtggctctgtgtgtgctgccacctactggagaagccataagctgcagctttaggaaaagggaacccggggcagagtgtggggaagtgggatggcagcatggcagggctttggaaaatgagaggtgagagtgtgtccaggaagggtgtaaggagaggatggatcctgatacatggattcaggatcattagggtcctgtctgggacactggccttcctgcttacctgctctttccttcctccttggtcggaggaggggctggctcactgctctggcttcattttccagagctgcctgctgcagtcacacttaggtcatcttctctcacttttctccttttgccgattagtggacgtgacagagatgtgaatggggcagggatgtcctttgatggcatcaagactttagcttctggtgcgctgtgtcccagctctgatttcagttgcagccgtgatggacagttgcatggaagctgagactctcactgacagtgaaaccctcaaatgaacacaatccctgctttcctgccaaggatccttgtagggtcccccagcttccccactttttttctgtgtccctctgcaaatgtgataggcacaggacaggagtaggcacctcgcctactgctgcttaacctttcagcttctccaggcccccaatcctgcttgctcccagcttggtaagtagatctgtgcacgtccctttacaccccaccatccagttttgcccagatgtgctagaatggggctggacaaagaaggaggggccagactagaggagtggtggtagagatagtgacagcctggggtgaggactttatgcctgtttaccactgagctctgggaaggaggccaggagtggggcaggtcaactgactgggagcaggggatctgggttccaagaaggagttgtgtttgaggtggggtctgggtcctcgtggaagtcaggactcccaggcagaaaagaggcaggctgcagggaagtaaggaggaggcatggcaccttctcatcgggcatcacaggtggggttttgccccacccctgaacgccctctgtggcgccttccacccacctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaacacaagtgagtggggtacat

SEQ ID NO: 361088 - DNA, 6747 bp, Homo sapiens
tccatacagggacaatatgtggctctggcctgtagtcgccatggcagccgtgtgctagatgccatctggagtggagcagccttgagggcccggaaggaaattgctgctgagcttggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatgtagcagcagtcaggctgggatcaagatgcctgggggacatcttgatcttggcctttcagggcaagtgggaggctagaaaggtggctaggaaagaacagcattcttcaggtaagggtatagacttgggatgtgaggcgttatgctgaaaggttctgtcacgaggggatcagaggacagtggggaaattgggtgggttatctagcctgtactgtctgcaggtcctgaaatttgatgctgtcatagtctttgcagtgggtcggttggaatgattctgggggcagaagctcagagccccttagtaggaatggaggcggcccttctgctgccactgctcagccccctccactgcatgacgaagggtggaggaaattcccagcaacatatggcccaggccttgcagcagtgtggaggtccaacgaaggagctccctgagtactttctttgggccaagtccttgaaagtcacaactcatagagtagagcccgtagaatgtggctttgacattcaggctgccaaagaggtctcgagggttttgcttgtacacgtcaaaggtgaatcgggcgatgtccttgctgtgcttgggcctctcccgtcccaggccatatgacagcactccactccttgtagggctccagctctgaccagactgcaacaccatcaggcacgtgtcatcctccagcagctggaagaagtcctcactgtccactgcagttccatcctcctctagcaccagggttagcactccattcagcagtagggtctccaatgcctttggctagcagctcctggcgggtggcagctgtcaggcctttccggatggtccgcttgtgatcacagacacggaaaggtcgctggggtggtggagctgaggtccagaccctccgtccaaactccgagcttatattagatactgacctgagtaagtcactggggttcagagctgagaggtactccatggtggaccggagagttccttccctggaacttctgggctgggtggttctctcctgtgctggggctttagtggtgttttctgttacaaacctgggatctcagcccaggacaaggtgggaatgagtcaagcctggactctggcccccctgcctggccagtaagaagggcaaagtccaaggggagggatgagggaggggccagatggggtcctggaggaagaattgcctggcaaaagccattggagcttgtatgtgtgtctttggtgatgacatgtgttgtgagggtagatgggaaccatgtaaaaggatgaaatgtgacttctggtgtttttttatttctatggagggactttctggggacggtttctggctctcaggctctgagaagctgcagtttatgagtggctctgtgtgtgctgccacctactggagaagccataagctgcagctttaggaaaagggaacccggggcagagtgtggggaagtgggatggcagcatggcagggctttggaaaatgagaggtgagagtgtgtccaggaagggtgtaaggagaggatggatcctgatacatggattcaggatcattagggtcctgtctgggacactggccttcctgcttacctgctctttccttcctccttggtcggaggaggggctggctcactgctctggcttcattttccagagctgcctgctgcagtcacacttaggtcatcttctctcacttttctccttttgccgattagtggacgtgacagagatgtgaatggggcagggatgtcctttgatggcatcaagactttagcttctggtgcgctgtgtcccagctctgatttcagttgcagccgtgatggacagttgcatggaagctgagactctcactgacagtgaaaccctcaaatgaacacaatccctgctttcctgccaaggatccttgtagggtcccccagcttccccactttttttctgtgtcctgacaaagaaacacagagtaacttgattgccctgtgacctggccagttgcatttcccctgcaggcttgagcccaagccagagccttgaaaaggtattcaggttgttgcccaaaacactgaaaaaaactggccctggccctgaaccaaataccttgaaccctcgtaaactccataccctgacccccttgttttggatatacccaggtagaacaactctctctcactgtctgttgtgaggatacgctgtagcccactcattaagtacattctcctaataaatgctttggactgatcaccctgccagtcttttgtcttgggcaatctatacttttctcagaggttcccaaggcctactgaagggacttaacatactcttaatggctttcctctctcttgttttaccttatgccctcacttcctgagttaacctcccaaatacaggatcacctgtacccaagcccttagctcaagaatacaggatcacctgtacccaagcccttagctcaagctctgctttggaagaacccaaactaagacagtgctcctggtgccctccccaagcaacctcaagttctggctgttacttgagcagaggcctttcttttcccttcccccagctctatccatctgccaggcccccctcaaatctcttcatttccaagttttgcttgacttttccaagaggagagggctgcttcttagtatgtccctactcatcctttcctttcttgtcttgtatcctggtgcagcctggtaatggggcctcttcatggttgtgtgtcatgactccctaaccattatgcctccatgcatcccctgttcctcctggaacctagcaccatgccttacatggaaaagctgtcattgacagcccggtgagagccctgagggtggagtgactggggcagggcctgaggcaagaggtgggaggaggtaggaggccaggggctcagccggaccaggagactggaaacaggcaaggataaggcaggtgggggactgagttgtttgggtcacctctgcaggccagagagaccaggcaacatacacactgcagaaggtgggctgggaggattggggccagagctgggggagggatgagaacagaagcaggaccaggattcagcagagtcctcctatttccttccaccaccagggaatcttactgccccacttcagcttgtgctgtttcctggcaaggcaggctctcacatgcctggacgcctgggtgcgttggtgatgggaaggagcagggtgagggaggggccccaggagaggcccaggatgagcctcatcttgtccctccccattcttgtcttaccctctgcaaatgtgataggcacaggacaggagtaggcacctcgcctactgctgcttaacctttcagcttctccaggcccccaatcctgcttgctcccagcttggtaagtagatctgtgcacgtccctttacaccccaccatccagttttgcccagatgtgctagaatggggctggacaaagaaggaggggccagactagaggagtggtggtagagatagtgacagcctggggtgaggactttatgcctgtttaccactgagctctgggaaggaggccaggagtggggcaggtcaactgactgggagcaggggatctgggttccaagaaggagttgtgtttgaggtggggtctgggtcctcgtggaagtcaggactcccaggcagaaaagaggcaggctgcagggaagtaaggaggaggcatggcaccttctcatcgggcatcacaggtggggttttgccccacccctgaacgccctctgtggcgccttccacccacctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaacacaagtgagtggggtacat

SEQ ID NO: 361089 - DNA, 7613 bp, Homo sapiens
tccatacagggacaatatgtggctctggcctgtagtcgccatggcagccgtgtgctagatgccatctggagtggagcagccttgagggcccggaaggaaattgctgctgagcttggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatgtagcagcagtcaggctgggatcaagatgcctgggggacatcttgatcttggcctttcagggcaagtgggaggctagaaaggtggctaggaaagaacagcattcttcaggtaagggtatagacttgggatgtgaggcgttaatgctgtcatagtctttgcagtgggtcggttggaatgattctgggggcagaagctcagagccccttagtaggaatggaggcggcccttctgctgccactgctcagccccctccactgcatgacgaagggtggaggaaattcccagcaacatatggcccaggccttgcagcagtgtggaggtccaacgaaggagctccccttgtagggctccagctctgaccagactgcaacaccatcaggcacgtgtcatcctccagcagctggaagaagtcctcactgtccactgcagttccatcctcctctagcaccagggttagcactccattcagcagtagggtctccaatgcctgcccaatggcaagaagcaagaagggcaggtcttatcccatgccccttccctctttagctgcccaacatccatcagttggctctagacattggtcgatgtcccactttgactttctggcactttgatacctcctaaaggttgcagctctccgtgttcttcagtttttgggggatcctagctagaggctgacctttttcctctttgctcctaccatgtcattggcatctccccttgctcccctccaagtcacttctggtttggaattggaaagcaagccaggttctcacgaagtccacccttctgtcttatctacaatgctgcacctcacttcccacaccctcaagagttctccagaagtgttttcagtaatagtgtttaacctttttgagtccttactctgtgccaggtatgaggactttacctacattatcctcttactcctttcaacaaccctaggaggtgatgtattattattgcctttttatagttgaagaaactgaggttttggtaggttgaacaacttcccaaggtttgacaggcaggaagtggcagaatcagaatttgaacttgatttgtcacacaaatcacctttccatactagcttctgaattccgtccctcgaactctccctatctcctgctaacccctgctcccatagaaaagctcactaggtggaaaatgaacaaattgaccagagctcattaggcccactccgctgcttttagccctcagagggaggggcagctgtgtgacttcagccctctgctccatcatcacaagttgccactgttgtggagccccttggctacccctgctataggaaccgaggaacttggcctacttactttggctagcagctcctggcgggtggcagctgtcaggcctttccggatggtccgcttgtgatcacagacacggaaaggtcgctggggtggtggagctgaggtccagaccctccgtccaaactccgagcttatattagatactgacctggtagttgagaagaaaagtcaagaaggggcgaggaggggcttggtgagtgtaaagggcatgatgagggtagagtggctagagggctagggagggagagatctaggtttatcgattagggatgagggagagaccatggagtgcaggtgggggcgggtggctcaggagcttgacaagcccactgtggagtggggagcaggagaggaaggggtactggttagtctcctaggggctgagtggagtattgttgccctgcctatatcccctaaaggtggagggtagagcggagggttagcagtcacctgagtaagtcactggggttcagagctgagaggtactccatggtggaccggagagttccttccctggaacttctgggctgggtggttctctcctgtgctggggctttagtggtgttttctgttacaaacctgggatctcagcccaggacaaggtgggaatgagtcaagcctggactctggcccccctgcctggccagtaagaagggcaaagtccaaggggagggatgagggaggggccagatggggtcctggaggaagaattgcctggcaaaagccattggagcttgtatgtgtgtctttggtgatgacatgtgttgtgagggtagatgggaaccatgtaaaaggatgaaatgtgacttctggtgtttttttatttctatggagggactttctggggacggtttctggctctcaggctctgagaagctgcagtttatgagtggctctgtgtgtgctgccacctactggagaagccataagctgcagctttaggaaaagggaacccggggcagagtgtggggaagtgggatggcagcatggcagggctttggaaaatgagaggtgagagtgtgtccaggaagggtgtaaggagaggatggatcctgatacatggattcaggatcattagggtcctgtctgggacactggccttcctgcttacctgctctttccttcctccttggtcggaggaggggctggctcactgctctggcttcattttccagagctgcctgctgcagtcacacttaggtcatcttctctcacttttctccttttgccgattagtggacgtgacagagatgtgaatggggcagggatgtcctttgatggcatcaagactttagcttctggtgcgctgtgtcccagctctgatttcagttgcagccgtgatggacagttgcatggaagctgagactctcactgacagtgaaaccctcaaatgaacacaatccctgctttcctgccaaggatccttgtagggtcccccagcttccccactttttttctgtgtcctgacaaagaaacacagagtaacttgattgccctgtgacctggccagttgcatttcccctgcaggcttgagcccaagccagagccttgaaaaggtattcaggttgttgcccaaaacactgaaaaaaactggccctggccctgaaccaaataccttgaaccctcgtaaactccataccctgacccccttgttttggatatacccaggtagaacaactctctctcactgtctgttgtgaggatacgctgtagcccactcattaagtacattctcctaataaatgctttggactgatcaccctgccagtcttttgtcttgggcaatctatacttttctcagaggttcccaaggcctactgaagggacttaacatactcttaatggctttcctctctcttgttttaccttatgccctcacttcctgagttaacctcccaaatacaggatcacctgtacccaagcccttagctcaagaatacaggatcacctgtacccaagcccttagctcaagctctgctttggaagaacccaaactaagacagtgctcctggtgccctccccaagcaacctcaagttctggctgttacttgagcagaggcctttcttttcccttcccccagctctatccatctgccaggcccccctcaaatctcttcatttccaagttttgcttgacttttccaagaggagagggctgcttcttagtatgtccctactcatcctttcctttcttgtcttgtatcctggtgcagcctggtaatggggcctcttcatggttgtgtgtcatgactccctaaccattatgcctccatgcatcccctgttcctcctggaacctagcaccatgccttacatggaaaagctgtcattgacagcccggtgagagccctgagggtggagtgactggggcagggcctgaggcaagaggtgggaggaggtaggaggccaggggctcagccggaccaggagactggaaacaggcaaggataaggcaggtgggggactgagttgtttgggtcacctctgcaggccagagagaccaggcaacatacacactgcagaaggtgggctgggaggattggggccagagctgggggagggatgagaacagaagcaggaccaggattcagcagagtcctcctatttccttccaccaccagggaatcttactgccccacttcagcttgtgctgtttcctggcaaggcaggctctcacatgcctggacgcctgggtgcgttggtgatgggaaggagcagggtgagggaggggccccaggagaggcccaggatgagcctcatcttgtccctccccattcttgtcttaccctctgcaaatgtgataggcacaggacaggagtaggcacctcgcctactgctgcttaacctttcagcttctccaggcccccaatcctgcttgctcccagcttggtaagtagatctgtgcacgtccctttacaccccaccatccagttttgcccagatgtgctagaatggggctggacaaagaaggaggggccagactagaggagtggtggtagagatagtgacagcctggggtgaggactttatgcctgtttaccactgagctctgggaaggaggccaggagtggggcaggtcaactgactgggagcaggggatctgggttccaagaaggagttgtgtttgaggtggggtctgggtcctcgtggaagtcaggactcccaggcagaaaagaggcaggctgcagggaagtaaggaggaggcatggcaccttctcatcgggcatcacaggtggggttttgccccacccctgaacgccctctgtggcgccttccacccacctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaacacaagtgagtggggtacat

SEQ ID NO: 361090 - DNA, 5934 bp, Homo sapiens
aacttacggctaggtcgaggctgggtgtaggcccactccgctgcttttagccctcagagggaggggcagctgtgtgacttcagccctctgctccatcatcacaagttgccactgttgtggagccccttggctacccctgctataggaaccgaggaacttggcctacttactttggctagcagctcctggcgggtggcagctgtcaggcctttccggatggtccgcttgtgatcacagacacggaaaggtcgctggggtggtggagctgaggtccagaccctccgtccaaactccgagcttatattagatactgacctggtagttgagaagaaaagtcaagaaggggcgaggaggggcttggtgagtgtaaagggcatgatgagggtagagtggctagagggctagggagggagagatctaggtttatcgattagggatgagggagagaccatggagtgcaggtgggggcgggtggctcaggagcttgacaagcccactgtggagtggggagcaggagaggaaggggtactggttagtctcctaggggctgagtggagtattgttgccctgcctatatcccctaaaggtggagggtagagcggagggttagcagtcacctgagtaagtcactggggttcagagctgagaggtactccatggtggaccggagagttccttccctggaacttctgggctgggtggttctctcctgtgctggggctttagtggtgttttctgttacaaacctgggatctcagcccaggacaaggtgggaatgagtcaagcctggactctggcccccctgcctggccagtaagaagggcaaagtccaaggggagggatgagggaggggccagatggggtcctggaggaagaattgcctggcaaaagccattggagcttgtatgtgtgtctttggtgatgacatgtgttgtgagggtagatgggaaccatgtaaaaggatgaaatgtgacttctggtgtttttttatttctatggagggactttctggggacggtttctggctctcaggctctgagaagctgcagtttatgagtggctctgtgtgtgctgccacctactggagaagccataagctgcagctttaggaaaagggaacccggggcagagtgtggggaagtgggatggcagcatggcagggctttggaaaatgagaggtgagagtgtgtccaggaagggtgtaaggagaggatggatcctgatacatggattcaggatcattagggtcctgtctgggacactggccttcctgcttacctgctctttccttcctccttggtcggaggaggggctggctcactgctctggcttcattttccagagctgcctgctgcagtcacacttaggtcatcttctctcacttttctccttttgccgattagtggacgtgacagagatgtgaatggggcagggatgtcctttgatggcatcaagactttagcttctggtgcgctgtgtcccagctctgatttcagttgcagccgtgatggacagttgcatggaagctgagactctcactgacagtgaaaccctcaaatgaacacaatccctgctttcctgccaaggatccttgtagggtcccccagcttccccactttttttctgtgtcctgacaaagaaacacagagtaacttgattgccctgtgacctggccagttgcatttcccctgcaggcttgagcccaagccagagccttgaaaaggtattcaggttgttgcccaaaacactgaaaaaaactggccctggccctgaaccaaataccttgaaccctcgtaaactccataccctgacccccttgttttggatatacccaggtagaacaactctctctcactgtctgttgtgaggatacgctgtagcccactcattaagtacattctcctaataaatgctttggactgatcaccctgccagtcttttgtcttgggcaatctatacttttctcagaggttcccaaggcctactgaagggacttaacatactcttaatggctttcctctctcttgttttaccttatgccctcacttcctgagttaacctcccaaatacaggatcacctgtacccaagcccttagctcaagaatacaggatcacctgtacccaagcccttagctcaagctctgctttggaagaacccaaactaagacagtgctcctggtgccctccccaagcaacctcaagttctggctgttacttgagcagaggcctttcttttcccttcccccagctctatccatctgccaggcccccctcaaatctcttcatttccaagttttgcttgacttttccaagaggagagggctgcttcttagtatgtccctactcatcctttcctttcttgtcttgtatcctggtgcagcctggtaatggggcctcttcatggttgtgtgtcatgactccctaaccattatgcctccatgcatcccctgttcctcctggaacctagcaccatgccttacatggaaaagctgtcattgacagcccggtgagagccctgagggtggagtgactggggcagggcctgaggcaagaggtgggaggaggtaggaggccaggggctcagccggaccaggagactggaaacaggcaaggataaggcaggtgggggactgagttgtttgggtcacctctgcaggccagagagaccaggcaacatacacactgcagaaggtgggctgggaggattggggccagagctgggggagggatgagaacagaagcaggaccaggattcagcagagtcctcctatttccttccaccaccagggaatcttactgccccacttcagcttgtgctgtttcctggcaaggcaggctctcacatgcctggacgcctgggtgcgttggtgatgggaaggagcagggtgagggaggggccccaggagaggcccaggatgagcctcatcttgtccctccccattcttgtcttaccctctgcaaatgtgataggcacaggacaggagtaggcacctcgcctactgctgcttaacctttcagcttctccaggcccccaatcctgcttgctcccagcttggtaagtagatctgtgcacgtccctttacaccccaccatccagttttgcccagatgtgctagaatggggctggacaaagaaggaggggccagactagaggagtggtggtagagatagtgacagcctggggtgaggactttatgcctgtttaccactgagctctgggaaggaggccaggagtggggcaggtcaactgactgggagcaggggatctgggttccaagaaggagttgtgtttgaggtggggtctgggtcctcgtggaagtcaggactcccaggcagaaaagaggcaggctgcagggaagtaaggaggaggcatggcaccttctcatcgggcatcacaggtggggttttgccccacccctgaacgccctctgtggcgccttccacccacctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaacacaagtgagtggggtacat

SEQ ID NO: 361091 - DNA, 4371 bp, Homo sapiens
tccatacagggacaatatgtggctctggcctgtagtcgccatggcagccgtgtgctagatgccatctggagtggagcagccttgagggcccggaaggaaattgctgctgagcttggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatgtagcagcagtcaggctgggatcaagatgcctgggggacatcttgatcttggcctttcagggcaagtgggaggctagaaaggtggctaggaaagaacagcattcttcaggtaagggtatagacttgggatgtgaggcgttatgctgaaaggttctgtcacgaggggatcagaggacagtggggaaattgggtgggttatctagcctgtactgtctgcaggtcctgaaatttgatgctgtcatagtctttgcagtgggtcggttggaatgattctgggggcagaagctcagagccccttagtaggaatggaggcggcccttctgctgccactgctcagccccctccactgcatgacgaagggtggaggaaattcccagcaacatatggcccaggccttgcagcagtgtggaggtccaacgaaggagctccctgagtactttctttgggccaagtccttgaaagtcacaactcatagagtagagcccgtagaatgtggctttgacattcaggctgccaaagaggtctcgagggttttgcttgtacacgtcaaaggtgaatcgggcgatgtccttgctgtgcttgggcctctcccgtcccaggccatatgacagcactccactccttgtagggctccagctctgaccagactgcaacaccatcaggcacgtgtcatcctccagcagctggaagaagtcctcactgtccactgcagttccatcctcctctagcaccagggttagcactccattcagcagtagggtctccaatgcctttggctagcagctcctggcgggtggcagctgtcaggcctttccggatggtccgcttgtgatcacagacacggaaaggtcgctggggtggtggagctgaggtccagaccctccgtccaaactccgagcttatattagatactgacctgagtaagtcactggggttcagagctgagaggtactccatggtggaccggagagttccttccctggaacttctgggctgggtggttctctcctgtgctggggctgctctttccttcctccttggtcggaggaggggctggctcactgctctggcttcattttccagagctgcctgctgcagtcacacttaggtcatcttctctcacttttctccttttgccgattagtggacgtgacagagatgtgaatggggcagggatgtcctttgatggcatcaagactttagcttctggtgcgctgtgtcccagctctgatttcagttgcagccgtgatggacagttgcatggaagctgagactctcactgacagtgaaaccctcaaatgaacacaatccctgctttcctgccaaggatccttgtagggtcccccagcttccccactttttttctgtgtcctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaacacaagtgagtggggtacat

SEQ ID NO: 361092 - DNA, 5973 bp, Homo sapiens
tccatacagggacaatatgtggctctggcctgtagtcgccatggcagccgtgtgctagatgccatctggagtggagcagccttgagggcccggaaggaaattgctgctgagcttggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatgtagcagcagtcaggctgggatcaagatgcctgggggacatcttgatcttggcctttcagggcaagtgggaggctagaaaggtggctaggaaagaacagcattcttcaggtaagggtatagacttgggatgtgaggcgttatgctgaaaggttctgtcacgaggggatcagaggacagtggggaaattgggtgggttatctagcctgtactgtctgcaggtcctgaaatttgatgctgtcatagtctttgcagtgggtcggttggaatgattctgggggcagaagctcagagccccttagtaggaatggaggcggcccttctgctgccactgctcagccccctccactgcatgacgaagggtggaggaaattcccagcaacatatggcccaggccttgcagcagtgtggaggtccaacgaaggagctccctgaatggcagagacaagaggaaatcagatgatttggaaaacttgggaggaagccatcaagctgggagatgaggactttccacaagcaagagctaactaggggtaggtgggtgcaagaggacgaattatggggactatccaactgtaggggatggggcagtatgacatgttgatttctgacctgagtactttctttgggccaagtccttgaaagtcacaactcatagagtagagcccgtagaatgtggctttgacattcaggctgccaaagaggtctcgagggttttgcttgtacacgtcaaaggtgaatcgggcgatgtccttgctgtgcttgggcctctcccgtcccaggccatatgacagcactccactctgtaggacacccttgtcagtgcagtagatcctcataccagacacccaccactaatctccatcagcactgggtcagaccctccctcgcttggactttctgtccactgtgtgacatccttgacaattccacaactcctcctgcacctggtccccaggatcagggttaagctagagaggaagcccgggaaagctctaaaggacaggcattggaagcagccccagtataggcctcttacccttgtagggctccagctctgaccagactgcaacaccatcaggcacgtgtcatcctccagcagctggaagaagtcctcactgtccactgcagttccatcctcctctagcaccagggttagcactccattcagcagtagggtctccaatgcctgcccaatggcaagaagcaagaagggcaggtcttatcccatgccccttccctctttagctgcccaacatccatcagttggctctagacattggtcgatgtcccactttgactttctggcactttgatacctcctaaaggttgcagctctccgtgttcttcagtttttgggggatcctagctagaggctgacctttttcctctttgctcctaccatgtcattggcatctccccttgctcccctccaagtcacttctggtttggaattggaaagcaagccaggttctcacgaagtccacccttctgtcttatctacaatgctgcacctcacttcccacaccctcaagagttctccagaagtgttttcagtaatagtgtttaacctttttgagtccttactctgtgccaggtatgaggactttacctacattatcctcttactcctttcaacaaccctaggaggtgatgtattattattgcctttttatagttgaagaaactgaggttttggtaggttgaacaacttcccaaggtttgacaggcaggaagtggcagaatcagaatttgaacttgatttgtcacacaaatcacctttccatactagcttctgaattccgtccctcgaactctccctatctcctgctaacccctgctcccatagaaaagctcactaggtggaaaatgaacaaattgaccagagctcattaggcccactccgctgcttttagccctcagagggaggggcagctgtgtgacttcagccctctgctccatcatcacaagttgccactgttgtggagccccttggctacccctgctataggaaccgaggaacttggcctacttactttggctagcagctcctggcgggtggcagctgtcaggcctttccggatggtccgcttgtgatcacagacacggaaaggtcgctggggtggtggagctgaggtccagaccctccgtccaaactccgagcttatattagatactgacctggtagttgagaagaaaagtcaagaaggggcgaggaggggcttggtgagtgtaaagggcatgatgagggtagagtggctagagggctagggagggagagatctaggtttatcgattagggatgagggagagaccatggagtgcaggtgggggcgggtggctcaggagcttgacaagcccactgtggagtggggagcaggagaggaaggggtactggttagtctcctaggggctgagtggagtattgttgccctgcctatatcccctaaaggtggagggtagagcggagggttagcagtcacctgagtaagtcactggggttcagagctgagaggtactccatggtggaccggagagttccttccctggaacttctgggctgggtggttctctcctgtgctggggctttagtggtgttttctgttacaaacctgggatctcactgctctttccttcctccttggtcggaggaggggctggctcactgctctggcttcattttccagagctgcctgctgcagtcacacttaggtcatcttctctcacttttctccttttgccgattagtggacgtgacagagatgtgaatggggcagggatgtcctttgatggcatcaagactttagcttctggtgcgctgtgtcccagctctgatttcagttgcagccgtgatggacagttgcatggaagctgagactctcactgacagtgaaaccctcaaatgaacacaatccctgctttcctgccaaggatccttgtagggtcccccagcttccccactttttttctgtgtcctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaacacaagtgagtggggtacat

SEQ ID NO: 361093 - DNA, 3645 bp, Homo sapiens
tccatacagggacaatatgtggctctggcctgtagtcgccatggcagccgtgtgctagatgccatctggagtggagcagccttgagggcccggaaggaaattgctgctgagcttggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatgtagcagcagtcaggctgggatcaagatgcctgggggacatcttgatcttggcctttcagggcaagtgggaggctagaaaggtggctaggaaagaacagcattcttcaggtaagggtatagacttgggatgtgaggcgttatgctgaaaggttctgtcacgaggggatcagaggacagtggggaaattgggtgggttatctagcctgtactgtctgcaggtcctgaaatttgatgctgtcatagtctttgcagtgggtcggttggaatgattctgggggcagaagctcagagccccttagtaggaatggaggcggcccttctgctgccactgctcagccccctccactgcatgacgaagggtggaggaaattcccagcaacatatggcccaggccttgcagcagtgtggaggtccaacgaaggagctccctgaatggcagagacaagaggaaatcagatgatttggaaaacttgggaggaagccatcaagctgggagatgaggactttccacaagcaagagctaactaggggtaggtgggtgcaagaggacgaattatggggactatccaactgtaggggatggggcagtatgacatgttgatttctgacctgagtactttctttgggccaagtccttgaaagtcacaactcatagagtagagcccgtagaatgtggctttgacattcaggctgccaaagaggtctcgagggttttgcttgtacacgtcaaaggtgaatcgggcgatgtccttgctgtgcttgggcctctcccgtcccaggccatatgacagcactccactctgtaggacacccttgtcagtgcagtagatcctcataccagacacccaccactaatctccatcagcactgggtcagaccctccctcgcttggactttctgtccactgtgtgacatccttgacaattccacaactcctcctgcacctggtccccaggatcagggttaagctagagaggaagcccgggaaagctctaaaggacaggcattggaagcagccccagtataggcctcttacccttgtagggctccagctctgaccagactgcaacaccatcaggcacgtgtcatcctccagcagctggaagaagtcctcactgtccactgcagttccatcctcctctagcaccagggttagcactccattcagcagtagggtctccaatgcctgcccaatggcaagaagcaagaagggcaggtcttatcccatgccccttccctctttagctgcccaacatccatcagttggctctagacattggtcgatgtcccactttgactttctggcactttgatacctcctaaaggttgcagctctccgtgttcttcagtttttgggggatcctagctagaggctgacctttttcctctttgctcctaccatgtcattggcatctccccttgctcccctccaagtcacttctggtttggaattggaaagcaagccaggttctcacgaagtccacccttctgtcttatctacaatgctgcacctcacttcccacaccctcaagagttctccagaagtgttttcagtaatagtgtttaacctttttgagtccttactctgtgccaggtatgaggactttacctacattatcctcttactcctttcaacaaccctaggaggtgatgtattattattgcctttttatagttgaagaaactgaggttttggtaggttgaacaacttcccaaggtttgacaggcaggaagtggcagaatcagaatttgaacttgatttgtcacacaaatcacctttccatactagcttctgaattccgtccctcgaactctccctatctcctgctaacccctgctcccatagaaaagctcactaggtggaaaatgaacaaattgaccagagctcattaggcccactccgctgcttttagccctcagagggaggggcagctgtgtgacttcagccctctgctccatcatcacaagttgccactgttgtggagccccttggctacccctgctataggaaccgaggaacttggcctacttactttggctagcagctcctggcgggtggcagctgtcaggcctttccggatggtccgcttgtgatcacagacacggaaaggtcgctggggtggtggagctgaggtccagaccctccgtccaaactccgagcttatattagatactgacctggtagttgagaagaaaagtcaagaaggggcgaggaggggcttggtgagtgtaaagggcatgatgagggtagagtggctagagggctagggagggagagatctaggtttatcgattagggatgagggagagaccatggagtgcaggtgggggcgggtggctcaggagcttgacaagcccactgtggagtggggagcaggagaggaaggggtactggttagtctcctaggggctgagtggagtattgttgccctgcctatatcccctaaaggtggagggtagagcggagggttagcagtcacctgagtaagtcactggggttcagagctgagaggtactccatggtggaccggagagttccttccctggaacttctgggctgggtggttctctcctgtgctggggctttagtggtgttttctgttacaaacctgggatctcagcccaggacaaggtgggaatgagtcaagcctggactctggcccccctgcctggccagtaagaagggcaaagtccaaggggagggatgagggaggggccagatggggtcctggaggaagaattgcctggcaaaagccattggagcttgtatgtgtgtctttggtgatgacatgtgttgtgagggtagatgggaaccatgtaaaaggatgaaatgtgaaaaaaaaaaaagaaagaaaaaagaaacgacaacgcgaagctgctggaacagaggagtgacagacaacagcaacgggagaagagaagcagcgagaagccgatacaaaagcaacggggggggggacgtaacaacacgacggaagacccgacacaccgcagaaagcaaagacgcgcccagatggattagaagcgaggcaacgctcgacagcaaggagaagggcggctagagaagccagggggggaaaagcacccacacgagacgggaaaacgcgggtcgacgtcgcgcaggaggaat

SEQ ID NO: 361094 - DNA, 3738 bp, Homo sapiens
tccatacagggacaatatgtggctctggcctgtagtcgccatggcagccgtgtgctagatgccatctggagtggagcagccttgagggcccggaaggaaattgctgctgagcttggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatgtagcagcagtcaggctgggatcaagatgcctgggggacatcttgatcttggcctttcagggcaagtgggaggctagaaaggtggctaggaaagaacagcattcttcaggtaagggtatagacttgggatgtgaggcgttatgctgaaaggttctgtcacgaggggatcagaggacagtggggaaattgggtgggttatctagcctgtactgtctgcaggtcctgaaatttgatgctgtcatagtctttgcagtgggtcggttggaatgattctgggggcagaagctcagagccccttagtaggaatggaggcggcccttctgctgccactgctcagccccctccactgcatgacgaagggtggaggaaattcccagcaacatatggcccaggccttgcagcagtgtggaggtccaacgaaggagctccctgaatggcagagacaagaggaaatcagatgatttggaaaacttgggaggaagccatcaagctgggagatgaggactttccacaagcaagagctaactagggggaatcttactgccccacttcagcttgtgctgtttcctggcaaggcaggctctcacatgcctggacgcctgggcacaggacaggagtaggcacctcgcctactgctgcttaacctttcagcttctccaggcccccaatcctgcttgctcccagcttggtggggttttgccccacccctgaacgccctctgtggcgccttccacccacctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaacacaagtgagtggggtacat

SEQ ID NO: 361095 - DNA, 3744 bp, Homo sapiens
gaccctggagtttctgtccccaaacacaggcctcacgggattctttctgtcctcatgcactgggcagaggttccttaacttcctttgttgcacattgccattctctcacatcccgtgcggtcaggaagcccttcctgaactctgacttcagttcttgctgcggtttctgcccatttttttcatatcctctgacagctgcgaggtcatctctgctctggcttttctccaagcagaacaagtgggggctctggaaaggttaagggacctcagtggccaccattatactttgcatctttcctgagaagtgagagttgaaagggaagcaggaaggcccatggtcagattgaaggaaggactttttagtttcttttttttttttttgaaatggagtctcgctctgtcattcaggctggagtgcagtggtgcgatctcagctcactgcagcctccacttcctgggttcacatgattctcctgcctcagcctcccaagtagctgagactacaggcacatgccactacacccagctaacttttgtatttttagtagagacggggtttcaccatgttggccaggctggtctcaaactgctaacatcaagtgatctgctcccctcagcctcccaaagtgctgggattaccggtatgaaccaccacaacctgccaggaatttttagtttttagcttttgcaggagacttcaaggaaaggagacattcctctgtccaggaaacgggtaaggggaccatttctgcattgctggtttcccctcttggcagggtgggcatgaggcatcactgttcctgctccctcactcctgctcctcatgctcagcctgccagctcggcctcaactttgtgtgtctaaagtggaactgaatagtaggctgtgagaagataggaaagaggtagtgccaatctccttgcccagatcataaatccagactcagcagggtaaccacatgggcaagcacaaggtaggtgcttggggaaaggggaagtaattggcattctgtgtgataccaaggagaccatttggattttggcttctaccaaagagaatggagaattggttgacctaaatggaaccagtccctttaagtaaggggaggaaagggggtgctggaagatggccctcttcccaccacctagatcatagcttgaactgaagccaaggacagagtgctgcccccttcggcatttactgatgtgccctctttaaatcatgatgttatctaacccaaacccagacccaggacctagtcacagctccaacctacacttcctattaatcttaaaacaaagcaaaacaaaacaaaaagatatcagcattgtagcctccaatctgagcccatttcccttctctggctaccatacctccttctcctatatgataccattcactactttgttcaattatccagtctagacctgcatcttgaggccacacccagccttctcactccccacacccctctttcctctctcactgctccttcctggtctcttctcatctggccccacctctaaggagtcctcctgccttctgggttgccctggaaaacagactatcccccctcctagtgaagggagtgggtaggggtttcagccccaccctcaggaagatgcgtcttccctgtcctctgctctgtggtacttcctctctggctgatttagcaaacagcacctagacctggggccaggcctttggcagtgggacagatccagggataggctacaccaccctgccctgaccctgggattggcatcagcttccaaccagttcctgccaaagcttgtaagtaagtttcctgggagcggccgtggttgtggtggtggtgggacagtgtgcagccatgaaagaaggtgcaaaggaatctccaaagaaagcctgaccagcgtaaaaagttgggaggctttgtccttgtcacttgtccactaaactcctcccctccctgttattcctggttgaccctgggcatctctggggacagtaggcaggtgattgggaaagttaatgggattgaggggctgagggcctggcagggggcaaaaagactggcctttcaaggggtgcagcattggtaggaactctgtttggttctgggctttagggtctcctaaggggaggagactgaaaaggtctggaaatgctgctgctgctgtggtcactgtatattttgcaattgggtctgtggacaggaaggggccgcatgacccagttaggaaactagtctttgtactcaaccagatccctttaagttgtcagtctgcagcgatgggggcagtatatttcagggggacctctgatgctgctgaccctggagatagactagagttctcagcctaggtgtgtccatggcgtcaggaaacccttggtcctctactctcatgcgtgtgtccgccctcactctccaggtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaacacaagtgagtggggtacat

SEQ ID NO: 361096 - DNA, 1807 bp, Homo sapiens
gaccctggagtttctgtccccaaacacaggcctcacgggattctttctgtcctcatgcactgggcagaggttccttaacttcctttgttgcacattgccattctctcacatcccgtgcggtcaggaagcccttcctgaactctgacttcagttcttgctgcggtttctgcccatttttttcatatcctctgacagctgcgaggtcatctctgctctggcttttctccaagcagaacaagtgggggctctggaaaggttaagggacctcagtggccaccattatactttgcatctttcctgagaagtgagagttgaaagggaagcaggaaggcccatggtcagattgaaggaaggactttttagtttcttttttttttttttgaaatggagtctcgctctgtcattcaggctggagtgcagtggtgcgatctcagctcactgcagcctccacttcctgggttcacatgattctcctgcctcagcctcccaagtagctgagactacaggcacatgccactacacccagctaacttttgtatttttagtagagacggggtttcaccatgttggccaggctggtctcaaactgctaacatcaagtgatctgctcccctcagcctcccaaagtgctgggattaccggtatgaaccaccacaacctgccaggaatttttagtttttagcttttgcaggagacttcaaggaaaggagacattcctctgtccaggaaacgggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaacacaagtgagtggggtacat

SEQ ID NO: 361097 - DNA, 2622 bp, Homo sapiens
gaccctggagtttctgtccccaaacacaggcctcacgggattctttctgtcctcatgcactgggcagaggttccttaacttcctttgttgcacattgccattctctcacatcccgtgcggtcaggaagcccttcctgaactctgacttcagttcttgctgcggtttctgcccatttttttcatatcctctgacagctgcgaggtcatctctgctctggcttttctccaagcagaacaagtgggggctctggaaaggttaagggacctcagtggccaccattatactttgcatctttcctgagaagtgagagttgaaagggaagcaggaaggcccatggtcagattgaaggaaggactttttagtttcttttttttttttttgaaatggagtctcgctctgtcattcaggctggagtgcagtggtgcgatctcagctcactgcagcctccacttcctgggttcacatgattctcctgcctcagcctcccaagtagctgagactacaggcacatgccactacacccagctaacttttgtatttttagtagagacggggtttcaccatgttggccaggctggtctcaaactgctaacatcaagtgatctgctcccctcagcctcccaaagtgctgggattaccggtatgaaccaccacaacctgccaggaatttttagtttttagcttttgcaggagacttcaaggaaaggagacattcctctgtccaggaaacgggtaaggggaccatttctgcattgctggtttcccctcttggcagggtgggcatgaggcatcactgttcctgctccctcactcctgctcctcatgctcagcctgccagctcggcctcaactttgtgtgtctaaagtggaactgaatagtaggctgtgagaagataggaaagaggtagtgccaatctccttgcccagatcataaatccagactcagcagggtaaccacatgggcaagcacaaggtaggtgcttggggaaaggggaagtaattggcattctgtgtgataccaaggagaccatttggattttggcttctaccaaagagaatggagaattggttgacctaaatggaaccagtccctttaagtaaggggaggaaagggggtgctggaagatggccctcttcccaccacctagatcatagcttgaactgaagccaaggacagagtgctgcccccttcggcatttactgatgtgccctctttaaatcatgatgttatctaacccaaacccagacccaggacctagtcacagctccaacctacacttcctattaatcttaaaacaaagcaaaacaaaacaaaaagatatcagcattgtagcctccaatctgagcccatttcccttctctggctaccatacctccttctcctatatgataccattcactactttgttcaattatccagtctagacctgcatcttgaggccacacccagccttctcactccccacacccctctttcctctctcactgctccttcctggtctcttctcatctggccccacctctaaggagtcctcctgccttctgggttgccctggaaaacagactatcccccctcctagtgaagggagtgggtaggggtttcagccccaccctcaggaagatgcgtcttccctgtcctctgctctgtggtacttcctctctggctgatttagcaaacagcacctagacctggggccaggcctttggcagtgggacagatccagggataggctacaccaccctgccctgaccctgggattggcatcagcttccaaccagttcctgccaaagcttgtaagtaagtttcctgggagcggccgtggttgtggtggtggtgggacagtgtgcagccatgaaagaaggtgcaaaggaatctccaaagaaagcctgaccagcgtaaaaagttgggaggctttgtccttgtcacttgtccactaaactcctcccctccctgttattcctggttgaccctgggcatctctggggacagtaggcaggtgattgggaaagttaatgggattgaggggctgagggcctggcagggggcaaaaagactggcctttcaaggggtgcagcattggtaggaactctgtttggttctgggctttagggtctcctaaggggaggagactgaaaaggtctggaaatgctgctgctgctgtggtcactgtatattttgcaattgggtctgtggacaggaaggggccgcatgacccagttaggaaactagtctttgtactcaaccagatccctttaagttgtcagtctgcagcgatgggggcagtatatttcagggggacctctgatgctgctgaccctggagatagactagagttctcagcctaggtgtgtccatggcgtcaggaaacccttggtcctactacatcttctgcagcacccccctcactaggtgtagagttcatctctctgctggctatcatcctgctgtcagtggcgctggctgtggggcttcccggcaacagcttttggagtggaagaagagggagaggtggagcaaagtgagggccgagtgagagcgtgctccagcctggctcccacaggcagctttaaccattaaaactgaagtctgaaatttggtcaacacaagtgagtggggtacat

SEQ ID NO: 361098 - DNA, 6279 bp, Homo sapiens
tccatacagggacaatatgtggctctggcctgtagtcgccatggcagccgtgtgctagatgccatctggagtggagcagccttgagggcccggaaggaaattgctgctgagcttggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatctttggctagcagctcctggcgggtggcagctgtcaggcctttccggatggtccgcttgtgatcacagacacggaaaggtcgctggggtggtggagctgaggtccagaccctccgtccaaactccgagcttatattagatactgacctggtagttgagaagaaaagtcaagaaggggcgaggaggggcttggtgagtgtaaagggcatgatgagggtagagtggctagagggctagggagggagagatctaggtttatcgattagggatgagggagagaccatggagtgcaggtgggggcgggtggctcaggagcttgacaagcccactgtggagtggggagcaggagaggaaggggtactggttagtctcctaggggctgagtggagtattgttgccctgcctatatcccctaaaggtggagggtagagcggagggttagcagtcacctgagtaagtcactggggttcagagctgagaggtactccatggtggaccggagagttccttccctggaacttctgggctgggtggttctctcctgtgctggggctttagtggtgttttctgttacaaacctgggatctcagcccaggacaaggtgggaatgagtcaagcctggactctggcccccctgcctggccagtaagaagggcaaagtccaaggggagggatgagggaggggccagatggggtcctggaggaagaattgcctggcaaaagccattggagcttgtatgtgtgtctttggtgatgacatgtgttgtgagggtagatgggaaccatgtaaaaggatgaaatgtgacttctggtgtttttttatttctatggagggactttctggggacggtttctggctctcaggctctgagaagctgcagtttatgagtggctctgtgtgtgctgccacctactggagaagccataagctgcagctttaggaaaagggaacccggggcagagtgtggggaagtgggatggcagcatggcagggctttggaaaatgagaggtgagagtgtgtccaggaagggtgtaaggagaggatggatcctgatacatggattcaggatcattagggtcctgtctgggacactggccttcctgcttacctgctctttccttcctccttggtcggaggaggggctggctcactgctctggcttcattttccagagctgcctgctgcagtcacacttaggtcatcttctctcacttttctccttttgccgattagtggacgtgacagagatgtgaatggggcagggatgtcctttgatggcatcaagactttagcttctggtgcgctgtgtcccagctctgatttcagttgcagccgtgatggacagttgcatggaagctgagactctcactgacagtgaaaccctcaaatgaacacaatccctgctttcctgccaaggatccttgtagggtcccccagcttccccactttttttctgtgtcctgacaaagaaacacagagtaacttgattgccctgtgacctggccagttgcatttcccctgcaggcttgagcccaagccagagccttgaaaaggtattcaggttgttgcccaaaacactgaaaaaaactggccctggccctgaaccaaataccttgaaccctcgtaaactccataccctgacccccttgttttggatatacccaggtagaacaactctctctcactgtctgttgtgaggatacgctgtagcccactcattaagtacattctcctaataaatgctttggactgatcaccctgccagtcttttgtcttgggcaatctatacttttctcagaggttcccaaggcctactgaagggacttaacatactcttaatggctttcctctctcttgttttaccttatgccctcacttcctgagttaacctcccaaatacaggatcacctgtacccaagcccttagctcaagaatacaggatcacctgtacccaagcccttagctcaagctctgctttggaagaacccaaactaagacagtgctcctggtgccctccccaagcaacctcaagttctggctgttacttgagcagaggcctttcttttcccttcccccagctctatccatctgccaggcccccctcaaatctcttcatttccaagttttgcttgacttttccaagaggagagggctgcttcttagtatgtccctactcatcctttcctttcttgtcttgtatcctggtgcagcctggtaatggggcctcttcatggttgtgtgtcatgactccctaaccattatgcctccatgcatcccctgttcctcctggaacctagcaccatgccttacatggaaaagctgtcattgacagcccggtgagagccctgagggtggagtgactggggcagggcctgaggcaagaggtgggaggaggtaggaggccaggggctcagccggaccaggagactggaaacaggcaaggataaggcaggtgggggactgagttgtttgggtcacctctgcaggccagagagaccaggcaacatacacactgcagaaggtgggctgggaggattggggccagagctgggggagggatgagaacagaagcaggaccaggattcagcagagtcctcctatttccttccaccaccagggaatcttactgccccacttcagcttgtgctgtttcctggcaaggcaggctctcacatgcctggacgcctgggtgcgttggtgatgggaaggagcagggtgagggaggggccccaggagaggcccaggatgagcctcatcttgtccctccccattcttgtcttaccctctgcaaatgtgataggcacaggacaggagtaggcacctcgcctactgctgcttaacctttcagcttctccaggcccccaatcctgcttgctcccagcttggtaagtagatctgtgcacgtccctttacaccccaccatccagttttgcccagatgtgctagaatggggctggacaaagaaggaggggccagactagaggagtggtggtagagatagtgacagcctggggtgaggactttatgcctgtttaccactgagctctgggaaggaggccaggagtggggcaggtcaactgactgggagcaggggatctgggttccaagaaggagttgtgtttgaggtggggtctgggtcctcgtggaagtcaggactcccaggcagaaaagaggcaggctgcagggaagtaaggaggaggcatggcaccttctcatcgggcatcacaggtggggttttgccccacccctgaacgccctctgtggcgccttccacccacctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaacacaagtgagtggggtacat

SEQ ID NO: 361099 - DNA, 4302 bp, Homo sapiens
tccatacagggacaatatgtggctctggcctgtagtcgccatggcagccgtgtgctagatgccatctggagtggagcagccttgagggcccggaaggaaattgctgctgagcttggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatgtagcagcagtcaggctgggatcaagatgcctgggggacatcttgatcttggcctttcagggcaagtgggaggctagaaaggtggctaggaaagaacagcattcttcaggtaagggtatagacttgggatgtgaggcgttatgctgaaaggttctgtcacgaggggatcagaggacagtggggaaattgggtgggttatctagcctgtactgtctgcaggtcctgaaatttgatgctgtcatagtctttgcagtgggtcggttggaatgattctgggggcagaagctcagagccccttagtaggaatggaggcggcccttctgctgccactgctcagccccctccactgcatgacgaagggtggaggaaattcccagcaacatatggcccaggccttgcagcagtgtggaggtccaacgaaggagctccctgaatggcagagacaagaggaaatcagatgatttggaaaacttgggaggaagccatcaagctgggagatgaggactttccacaagcaagagctaactaggggtaggtgggtgcaagaggacgaattatggggactatccaactgtaggggatggggcagtatgacatgttgatttctgacctgagtactttctttgggccaagtccttgaaagtcacaactcatagagtagagcccgtagaatgtggctttgacattcaggctgccaaagaggtctcgagggttttgcttgtacacgtcaaaggtgaatcgggcgatgtccttgctgtgcttgggcctctcccgtcccaggccatatgacagcactccactctgtaggacacccttgtcagtgcagtagatcctcataccagacacccaccactaatctccatcagcactgggtcagaccctccctcgcttggactttctgtccactgtgtgacatccttgacaattccacaactcctcctgcacctggtccccaggatcagggttaagctagagaggaagcccgggaaagctctaaaggacaggcattggaagcagccccagtataggcctcttacccttgtagggctccagctctgaccagactgcaacaccatcaggcacgtgtcatcctccagcagctggaagaagtcctcactgtccactgcagttccatcctcctctagcaccagggttagcactccattcagcagtagggtctccaatgcctgcccaatggcaagaagcaagaagggcaggtcttatcccatgccccttccctctttagctgcccaacatccatcagttggctctagacattggtcgatgtcccactttgactttctggcactttgatacctcctaaaggttgcagctctccgtgttcttcagtttttgggggatcctagctagaggctgacctttttcctctttgctcctaccatgtcattggcatctccccttgctcccctccaagtcacttctggtttggaattggaaagcaagccaggttctcacgaagtccacccttctgtcttatctacaatgctgcacctcacttcccacaccctcaagagttctccagaagtgttttcagtaatagtgtttaacctttttgagtccttactctgtgccaggtatgaggactttacctacattatcctcttactcctttcaacaaccctaggaggtgatgtattattattgcctttttatagttgaagaaactgaggttttggtaggttgaacaacttcccaaggtttgacaggcaggaagtggcagaatcagaatttgaacttgatttgtcacacaaatcacctttccatactagcttctgaattccgtccctcgaactctccctatctcctgctaacccctgctcccatagaaaagctcactaggtggaaaatgaacaaattgaccagagctcattaggcccactccgctgcttttagccctcagagggaggggcagctgtgtgacttcagccctctgctccatcatcacaagttgccactgttgtggagccccttggctacccctgctataggaaccgaggaacttggcctacttactttggctagcagctcctggcgggtggcagctgtcaggcctttccggatggtccgcttgtgatcacagacacggaaaggtcgctggggtggtggagctgaggtccagaccctccgtccaaactccgagcttatattagatactgacctggtagttgagaagaaaagtcaagaaggggcgaggaggggcttggtgagtgtaaagggcatgatgagggtagagtggctagagggctagggagggagagatctaggtttatcgattagggatgagggagagaccatggagtgcaggtgggggcgggtggctcaggagcttgacaagcccactgtggagtggggagcaggagaggaaggggtactggttagtctcctaggggctgagtggagtattgttgccctgcctatatcccctaaaggtggagggtagagcggagggttagcagtcacctgagtaagtcactggggttcagagctgagaggtactccatggtggaccggagagttccttccctggaacttctgggctgggtggttctctcctgtgctggggctttagtggtgttttctgttacaaacctgggatctcagcccaggacaaggtgggaatgagtcaagcctggactctggcccccctgcctggccagtaagaagggcaaagtccaaggggagggatgagggaggggccagatggggtcctggaggaagaattgcctggcaaaagccattggagcttgtatgtgtgtctttggtgatgacatgtgttgtgagggtagatgggaaccatgtaaaaggatgaaatgtgacttctggtgtttttttatttctatggagggactttctggggacggtttctggctctcaggctctgagaagctgcagtttatgagtggctctgtgtgtgctgccacctactggagaagccataagctgcagctttaggaaaagggaacccggggcagagtgtggggaagtgggatggcagcatggcagggctttggaaaatgagaggtgagagtgtgtccaggaagggtgtaaggagaggatggatcctgatacatggattcaggatcattagggtcctgtctgggacactggccttcctgcttacctgctctttccttcctccttggtcggaggaggggctggctcactgctctggcttcattttccagagctgcctgctgcagtcacacttaggtcatcttctctcacttttctccttttgccgattagtggacgtgacagagatgtgaatggggcagggatgtcctttgatggcatcaagactttagcttctggtgcgctgtgtcccagctctgatttcagttgcagccgtgatggacagttgcatggaagctgagactctcactgacagtgaaaccctcaaatgaacacaatccctgctttcctgccaaggatccttgtagggtcccccagcttccccactttttttctgtgtcctgacaaagaaacacagagtaacttgattgccctgtgacctggccagttgcatttcccctgcaggcttgagcccaagccagagccttgaaaaggtattcaggttgttgcccaaaacactgaaaaaaactggccctggccctgaaccaaataccttgaaccctcgtaaactccataccctgacccccttgttttggatatacccaggtagaacaactctctctcactgtctgttgtgaggatacgctgtagcccactcattaagtacattctcctaataaatgctttggactgat

SEQ ID NO: 361100 - DNA, 728 bp, Homo sapiens
tccatacagggacaatatgtggctctggcctgtagtcgccatggcagccgtgtgctagatgccatctggagtggagcagccttgagggcccggaaggaaattgctgctgagcttggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatgtagcagcagtcaggctgggatcaagatgcctgggggacatcttgatcttggcctttcagggcaagtgggaggctagaaaggtgggagtcctagttttatggccagggccagggttattattgttattgctactgggttaaatatttttgtaatggtccattggccagaatataggagttgatgatgatggctattattatatcgtatcgtgtg

SEQ ID NO: 361101 - DNA, 3130 bp, Homo sapiens
ctgtatttcaaaaaaaaagaataaacaggaacacaaaaagccagcagcctggagcagtttagctaaggggttgctgtcctgcacagtcagtaggctctgaaggccatgtctgaaccacagccctgcctgcgaatgaatctcaaggatagtcattggcttactttatttttaaaacctcctctttaaagatttcctcttgaagagacagctcactttctacatagtcccgtatggaagtggactgctgaagaaattagtgtttccattcccctccaccgtctcccccattttttccgaacatttctttgtctttgtccattttcatcgctgagctgaagagcatgctttatcagaaacccttttgtccctttccttttccatgcttagagggaagtttctgacttgggagaacgccttagagttcttggggtctgaactcctctgatgccttccaaagtcacgtagctgtaagacccagcgggtgccagccgggagggtgactccagctcagcagcatgtatggaagtgcattgtgaccatgaaggagtctgccagtggccaagccacctagtgagctccctaccaaggaacctgggtgtcacctgcaggtggccaagagccagtttttatgccaggcaggggactggttggactctattgaggcttcttcctgtctgtggggagcactcctgtccccctcgtggtagggatacctgtcaccccacaaagaggcagggtgacaggtgttggccccattttaggcagacttgggtgtcatgacttctagttcacttgttttaaacctacctgtgatggcagctgcaccatgctgccctcttgacacactgctggagcccagagcacaggccagagtctcagcctgagccccttccccaggcagtacctgacaaggatacctgggattggggccagctttccagtcagatgccacgtttcctttgcccactgccacggggcactagggcctgccgcaggctctcccatgagggagaacgacctctgcaggcccctctgccttcctgcttcctaattgaccctttctctggcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaacactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccttcagtggatggaacgtgagtgtctgatcatctctcttggaagttttctgaaccttccaagctctgtggtgaggacaaaccagtgtttgaatcatatgctgataactgtttgcctgtgaccctcacaccttgttcttcagggttttaatgattttctgttgacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccagtgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagggttacctcagtctttagccattactgcttatttcttttccccaagtcacaaaaaacttgtaagctgctgggttaaagcagaggccacctgtcagatctaccctacccttatttggttacatggcacctgagagtttcactcagaccagggatcttccttaggagggtcaaagtgcagatcagaccatgcaggtaaggtgaaccagctgcacggaccaggttcccgcaaaacattgccagctagtgaggcataatttgctcaaagtatagaaacagcccacctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagctggtatgagagaaaaaaaaaaa

SEQ ID NO: 361102 - DNA, 2006 bp, Homo sapiens
ggtttgtatccaatgtctggcacgtggttagatgctcacagatgcctgtagttgaatttcattctagtaaactagtgaaatgattcccatgaggaggtgagccagtggtaatgcccagagtcctggctctatctggttagaggttcacccctggcactgtctcatggtatcctagctggtctcgacttcctgtctggtgcagccggattagtgagaaactttccctctctactggcttctctcccttattcttatcgtgtccctaccaccagtcccttaatatgtttgccctgtgtttcccactttaccaaaggagtaggtagacaggcaagtcagattccaggtagaggatgtatagactggctagttcaagggtttgggggcagaatacctctattactttgtatgtttatatggcaggtttgcttaacaaaacaactgaaacttctctaaaaatctctctctctctctcttttaaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtgaggctgcgcagagctggtgctccacacgggctggaaatgctgtctgggtgctaatcgtgagatacacagactagatgtcagggaagtgagctgtatcacaacatgtattgggtgtgccatgaattcctcttgtttcccagtcttctcttcacccttcctggccttatttccattccatgtcacctgccaaagtgttcttgctgaggtttacttccttgagatcacagacagcctctttatgaggttttctaacgctctgaaagtcttacctggccttggtttgggttagttgccatctcctgacattctcaagccattcctctagaatctttcggagtgtcttcctggtcgcttctgatgctcattggccataagggcttgtgtaagtgtttgtggctgcatgttccctttctccacatttccccatgtgctgcatcagattcccccaaatacagcaccttctcctgctattcattttgcctgatgccatcattttaaggcctttttccattttagctgtcctccaagtattccgatgattctgtggctttccaatccagtaaatatatcctagatcagagatgagaccaaaagtaaaagaatcaacagccaaaccgacacaggtgttattaaaggacttactgtttaaacatgcctaaaccctgtgccttgagtgtgcaagctgacttattagaaaaggacagggctggctgacctgtccctatcagtcccaagtcatgcaccctgtgccccgggaagtgggcggtgaccctatgctggtggtgtggcatcacaggcccggggcagggagtgctgtgtaaacctgggatgtagagccgcattcccccactccctgtgcatgctgggcttggccccacattatgccaagggaagcgggacctcttttgtcattggccatcctagccacccctccctgccttgtgcctgcatgaggttgggagacttgatgaataaagaatccctgaaggactctgttccttcttcaaaa

SEQ ID NO: 361103 - DNA, 881 bp, Homo sapiens
ggtttgtatccaatgtctggcacgtggttagatgctcacagatgcctgtagttgaatttcattctagtaaactagtgaaatgattcccatgaggaggtgagccagtggtaatgcccagagtcctggctctatctggttagaggttcacccctggcactgtctcatggtatcctagctggtctcgacttcctgtctggtgcagccggattagtgagaaactttccctctctactggcttctctcccttattcttatcgtgtccctaccaccagtcccttaatatgtttgccctgtgtttcccactttaccaaaggagtaggtagacaggcaagtcagattccaggtagaggatgtatagactggctagttcaagggtttgggggcagaatacctctattactttgtatgtttatatggcaggtttgcttaacaaaacaactgaaacttctctaaaaatctctctctctctctcttttaaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggtaaatgcttttaaagaaacataaataagttgtatggtttccacaattatacgtgttgttggaatcaggatagatcatgctttaaaaggatatgattgggccaggcgcggtggttcatgtctgtaatttcagcactttgggaggccaaggtgggagaattgttttaggccaggatttcaagaccaaccggggcaacatagtgatactccccatctcaaaa

SEQ ID NO: 361104 - DNA, 957 bp, Homo sapiens
agcggagtcccacccttcggcgcagggctccggccaacacagccctccaggccgcctactctccagccagccggctccacggacccacggaagggcaagggggcggcgtcggggcggcgggacagttgtcggagggcgccctccaggcccaagccgccttctccggcccccgccatggcccggggcggcagtcagagctggagctccggggaatcagacgggcagccaaaggagcagacgcccgagaagcccagacacaagatggtgaaggagacccagtactatgacatcctgggcgtgaagcccagcgcgtccccggaggagatcaagaaggcctatcggaagctggcgctcaagtaccacccggacaagaacccggatgagggcgagaagggacacggacatctgcaacctgacatcagcttgtactcatattctgggttttcggtgacaagtgacacacagttgatcataagtaccaatcatagactgaaaatgctctgcattttagagacagaagttaaaagcttttccatcctgtttacagaaagtttgctttttatctctaaagaggctcatgacccacctgaataggtgaattgaaggatgaggcattgcaaggaaaggctgctaaccctcccgttcctcctttcacttcttgccattttcttacaaaactttggttgttccgcatgggtcttgagaggtggggccgttatagtagctgatagcagtgtcacttgggccacgtttgaaaccacaccaatcacccatgtagcatttaagacctgtggaaacgacgctggaatcaaaatacctgtctgtgttagttgttccaagctggagaaagctacttcaggacggttggctgaatggcaacagtgatggaatatttatatttagccacatgtgctgaatgtggctgtcacaagtttaaaatgctttcctgtaagacca

SEQ ID NO: 361105 - DNA, 866 bp, Homo sapiens
ggtttgtatccaatgtctggcacgtggttagatgctcacagatgcctgtagttgaatttcattctagtaaactagtgaaatgattcccatgaggaggtgagccagtggtaatgcccagagtcctggctctatctggttagaggttcacccctggcactgtctcatggtatcctagctggtctcgacttcctgtctggtgcagccggattagtgagaaactttccctctctactggcttctctcccttattcttatcgtgtccctaccaccagtcccttaatatgtttgccctgtgtttcccactttaccaaaggagtaggtagacaggcaagtcagattccaggtagaggatgtatagactggctagttcaagggtttgggggcagaatacctctattactttgtatgtttatatggcaggtttgcttaacaaaacaactgaaacttctctaaaaatctctctctctctctcttttaaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaagccatgtagttagggaagaagggatcggtggacgaaattgcctacatgcgcgatgtagcgaggggatacagatccacatgccttcagatccatatcgcagc

SEQ ID NO: 361106 - DNA, 371 bp, Homo sapiens
acagtctcctttaaggagagcttgtaggcttctaatttcacatttcagcaagctggctaaagacatgtgggaaagcctgaccctggattcaggtcaaatctcagcactcacaagagtaagttcatgcctctgtgtatacagttagagctgaatatgcttttgttctgaagcttttatttttaaaaaattagacttgacctgtactacatatgtgtaggtttcaccctgtctatacctgtctgggcaggttgtttggtttgttttaaactaatatttattcatagccaggcactgagttagtgtcacataaatgaggcccttggcagtgaggtctggcaggcccatcagcttggagggaagggttctgtgat

SEQ ID NO: 361107 - DNA, 2321 bp, Homo sapiens
ctgtatttcaaaaaaaaagaataaacaggaacacaaaaagccagcagcctggagcagtttagctaaggggttgctgtcctgcacagtcagtaggctctgaaggccatgtctgaaccacagccctgcctgcgaatgaatctcaaggatagtcattggcttactttatttttaaaacctcctctttaaagatttcctcttgaagagacagctcactttctacatagtcccgtatggaagtggactgctgaagaaattagtgtttccattcccctccaccgtctcccccattttttccgaacatttctttgtctttgtccattttcatcgctgagctgaagagcatgctttatcagaaacccttttgtccctttccttttccatgcttagagggaagtttctgacttgggagaacgccttagagttcttggggtctgaactcctctgatgccttccaaagtcacgtagctgtaagacccagcgggtgccagccgggagggtgactccagctcagcagcatgtatggaagtgcattgtgaccatgaaggagtctgccagtggccaagccacctagtgagctccctaccaaggaacctgggtgtcacctgcaggtggccaagagccagtttttatgccaggcaggggactggttggactctattgaggcttcttcctgtctgtggggagcactcctgtccccctcgtggtagggatacctgtcaccccacaaagaggcagggtgacaggtgttggccccattttaggcagacttgggtgtcatgacttctagttcacttgttttaaacctacctgtgatggcagctgcaccatgctgccctcttgacacactgctggagcccagagcacaggccagagtctcagcctgagccccttccccaggcagtacctgacaaggatacctgggattggggccagctttccagtcagatgccacgtttcctttgcccactgccacggggcactagggcctgccgcaggctctcccatgagggagaacgacctctgcaggcccctctgccttcctgcttcctaattgaccctttctctggcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaacactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccttcagtggatggaacgtgagtgtctgatcatctctcttggaagttttctgaaccttccaagctctgtggtgaggacaaaccagtgtttgaatcatatgctgataactgtttgcctgtgaccctcacaccttgttcttcagggttttaatgattttctgttgacaacttttgcaatgctttcccaccaaagtgcttacttgtaaagaaaactaaatccttctgtgtccccggcagcctcagtgcagcaacagaagccaagggagaatgaaggtggaaaacactggggagttctattgcctttgcagaccactcaagtcaccccggattactggttagagaagctgc

SEQ ID NO: 361108 - DNA, 2258 bp, Homo sapiens
ctgtatttcaaaaaaaaagaataaacaggaacacaaaaagccagcagcctggagcagtttagctaaggggttgctgtcctgcacagtcagtaggctctgaaggccatgtctgaaccacagccctgcctgcgaatgaatctcaaggatagtcattggcttactttatttttaaaacctcctctttaaagatttcctcttgaagagacagctcactttctacatagtcccgtatggaagtggactgctgaagaaattagtgtttccattcccctccaccgtctcccccattttttccgaacatttctttgtctttgtccattttcatcgctgagctgaagagcatgctttatcagaaacccttttgtccctttccttttccatgcttagagggaagtttctgacttgggagaacgccttagagttcttggggtctgaactcctctgatgccttccaaagtcacgtagctgtaagacccagcgggtgccagccgggagggtgactccagctcagcagcatgtatggaagtgcattgtgaccatgaaggagtctgccagtggccaagccacctagtgagctccctaccaaggaacctgggtgtcacctgcaggtggccaagagccagtttttatgccaggcaggggactggttggactctattgaggcttcttcctgtctgtggggagcactcctgtccccctcgtggtagggatacctgtcaccccacaaagaggcagggtgacaggtgttggccccattttaggcagacttgggtgtcatgacttctagttcacttgttttaaacctacctgtgatggcagctgcaccatgctgccctcttgacacactgctggagcccagagcacaggccagagtctcagcctgagccccttccccaggcagtacctgacaaggatacctgggattggggccagctttccagtcagatgccacgtttcctttgcccactgccacggggcactagggcctgccgcaggctctcccatgagggagaacgacctctgcaggcccctctgccttcctgcttcctaattgaccctttctctggcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaacactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagctggtatgagagaaaaaaaaaaa

SEQ ID NO: 361109 - DNA, 2335 bp, Homo sapiens
agcggagtcccacccttcggcgcagggctccggccaacacagccctccaggccgcctactctccagccagccggctccacggacccacggaagggcaagggggcggcgtcggggcggcgggacagttgtcggagggcgccctccaggcccaagccgccttctccggcccccgccatggcccggggcggcagtcagagctggagctccggggaatcagacgggcagccaaaggagcagacgcccgagaagcccagacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaagacaggtcatgcacaagcatgggcaacaagcatactcatttccatggcagcacaggcaccatccagcgcagcctagagcatggcagccgtggctgcatgtccatccatctgtcgcttgcatcccgacaggcatcacatagtagtacttatccagcagcacgcaggccgatagacttagactccatgcacacactgcaccacattcaagcttatctgcaagctccttccgatcggcttcacagcaagcacgataacaaaaacgatttgggagcaatcgcacttcgtcgcttccttagcatccagaagcagcgtgacggtcgataacagcaacggaggacctgacgcatgcgtgcgacgatgacacggaatgcccatactaccaacgcacccctggaaacaaagcgggacttccttgcactccataacaggatatcacaagaggatacactctaatacaccatgaaaaaaacaacatgagactaagcatcatggaaaaacagcattcacacaagacatgagcacgactctatacatcacgtccctacgacccgacacagtgaagggatataacacggaagtgacccagtagacactcacagtaaggacgacgcaagcaacgagaaacattaccgacacacaaagatgaagccagcaaacatgagcgggtcaaagcgccggaggaacaggcccaaagaagagacacgagacccaaagaacagggacacaccaaaggcaagaggagcagcacagagaaccgcacaggacctgcacgtcaggaatgcccgagaccacagagaaggacacacgcacacggaaaagcaacgcagcaatgaaagaaaaagaacacagatgaggccacacatgcacagaacgaaaccacaacaataacaaagacaacagatagcgataaaaggaaatagacccaaagcagacaagacaataaacgacacataaaactacgaacatcgaaccacaacgtacgcagtaaaggcagcagcaagaataaagaagacagttaatagcaacctacaaaccaacatgcaccacatacaacaacctaactagtatacaacgtcaaatataacggactaagagatctcagaactcgaaagcactgtagcacaagcacacaaagacgacacacatcagatcgaacctgcggcacaaccagacgcgacacacgcagcccagaacggaaaactcaaagacagagagacgacagagccatagacacaaaccacgagcagcacagacgacgacacagcgagaactgacgacacgtgacacgcggacggacgaacagtgacagccagagaagagagcactgaaagaagaaagagagacaaggacgaaagagacaagaagcaccaagtagaacggcaacgaagacgccatagagactcgttgccgggaagcaagaaaaacgaaa

SEQ ID NO: 361110 - DNA, 1865 bp, Homo sapiens
agcggagtcccacccttcggcgcagggctccggccaacacagccctccaggccgcctactctccagccagccggctccacggacccacggaagggcaagggggcggcgtcggggcggcgggacagttgtcggagggcgccctccaggcccaagccgccttctccggcccccgccatggcccggggcggcagtcagagctggagctccggggaatcagacgggcagccaaaggagcagacgcccgagaagcccagacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtgaggctgcgcagagctggtgctccacacgggctggaaatgctgtctgggtgctaatcgtgagatacacagactagatgtcagggaagtgagctgtatcacaacatgtattgggtgtgccatgaattcctcttgtttcccagtcttctcttcacccttcctggccttatttccattccatgtcacctgccaaagtgttcttgctgaggtttacttccttgagatcacagacagcctctttatgaggttttctaacgctctgaaagtcttacctggccttggtttgggttagttgccatctcctgacattctcaagccattcctctagaatctttcggagtgtcttcctggtcgcttctgatgctcattggccataagggcttgtgtaagtgtttgtggctgcatgttccctttctccacatttccccatgtgctgcatcagattcccccaaatacagcaccttctcctgctattcattttgcctgatgccatcattttaaggcctttttccattttagctgtcctccaagtattccgatgattctgtggctttccaatccagtaaatatatcctagatcagagatgagaccaaaagtaaaagaatcaacagccaaaccgacacaggtgttattaaaggacttactgtttaaacatgcctaaaccctgtgccttgagtgtgcaagctgacttattaggccccgggaagtgggcggtgaccctatgctggtggtgtggcatcacaggcccggggcagggagtgctgtgtaaacctgggatgtagagccgcattcccccactccctgtgcatgctgggcttggccccacattatgccaagggaagcgggacctcttttgtcattggccatcctagccacccctccctgccttgtgcctgcatgaggttgggagacttgatgaataaagaatccctgaaggactctgttccttcttcaaaa

SEQ ID NO: 361111 - DNA, 1295 bp, Homo sapiens
agcggagtcccacccttcggcgcagggctccggccaacacagccctccaggccgcctactctccagccagccggctccacggacccacggaagggcaagggggcggcgtcggggcggcgggacagttgtcggagggcgccctccaggcccaagccgccttctccggcccccgccatggcccggggcggcagtcagagctggagctccggggaatcagacgggcagccaaaggagcagacgcccgagaagcccagacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaagaacactgcacgtggatcacaatgcacttgataagatcctg

SEQ ID NO: 361112 - DNA, 415 bp, Homo sapiens
gaatcgggaaactgaggcacacacaaacagttgtttacttgctgggaacgactggctcatattctctgttgatgcataaaccctagggatgagtgtctttaatctgagctggtaccttggacaaacgccgtgcctctcttgagaatgactagctggatttgttctgtgcacctactgcctacctgataaaagcgtcagatagtgaataatcccattttctttattaaacagggacacggacatctgcaacctgacatcagcttgtactcatattctgggttttcggtgacaagtgacacacagttgatcataagtaccaatcatagactgaaaatgctctgcattttagagacagaagttaaaagcttttccatcctgtttacagaaagtttgctttttatctctaaagaggctc

SEQ ID NO: 361113 - DNA, 3198 bp, Homo sapiens
agcggagtcccacccttcggcgcagggctccggccaacacagccctccaggccgcctactctccagccagccggctccacggacccacggaagggcaagggggcggcgtcggggcggcgggacagttgtcggagggcgccctccaggcccaagccgccttctccggcccccgccatggcccggggcggcagtcagagctggagctccggggaatcagacgggcagccaaaggagcagacgcccgagaagcccagacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaacactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccttcagtggatggaacgtgagtgtctgatcatctctcttggaagttttctgaaccttccaagctctgtggtgaggacaaaccagtgtttgaatcatatgctgataactgtttgcctgtgaccctcacaccttgttcttcagggttttaatgattttctgttgacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccagtgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagggttacctcagtctttagccattactgcttatttcttttccccaagtcacaaaaaacttgtaagctgctgggttaaagcagaggccacctgtcagatctaccctacccttatttggttacatggcacctgagagtttcactcagaccagggatcttccttaggagggtcaaagtgcagatcagaccatgcaggtaaggtgaaccagctgcacggaccaggttcccgcaaaacattgccagctagtgaggcataatttgctcaaagtatagaaacagcccacctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagctggtatgagagaaaaaaaaaaa

SEQ ID NO: 361114 - DNA, 3117 bp, Homo sapiens
gaagtcggtccggcgcggggcggggggcgggcgggagctacaagcggcggcggcggcggcgaccgtgaccgtgacgcgcgagcgggcggcgggggcgcgggccaggggcgcgggccagggtgccggcaggggcgtccggggcgctctgaccggcctcgcccgcccccccgcagacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaacactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccttcagtggatggaacgtgagtgtctgatcatctctcttggaagttttctgaaccttccaagctctgtggtgaggacaaaccagtgtttgaatcatatgctgataactgtttgcctgtgaccctcacaccttgttcttcagggttttaatgattttctgttgacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccagtgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagggttacctcagtctttagccattactgcttatttcttttccccaagtcacaaaaaacttgtaagctgctgggttaaagcagaggccacctgtcagatctaccctacccttatttggttacatggcacctgagagtttcactcagaccagggatcttccttaggagggtcaaagtgcagatcagaccatgcaggtaaggtgaaccagctgcacggaccaggttcccgcaaaacattgccagctagtgaggcataatttgctcaaagtatagaaacagcccacctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagctggtatgagagaaaaaaaaaaa

SEQ ID NO: 361115 - DNA, 2920 bp, Homo sapiens
acagtctcctttaaggagagcttgtaggcttctaatttcacatttcagcaagctggctaaagacatgtgggaaagcctgaccctggattcaggtcaaatctcagcactcacaagatttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaacactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccttcagtggatggaacgtgagtgtctgatcatctctcttggaagttttctgaaccttccaagctctgtggtgaggacaaaccagtgtttgaatcatatgctgataactgtttgcctgtgaccctcacaccttgttcttcagggttttaatgattttctgttgacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccagtgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagggttacctcagtctttagccattactgcttatttcttttccccaagtcacaaaaaacttgtaagctgctgggttaaagcagaggccacctgtcagatctaccctacccttatttggttacatggcacctgagagtttcactcagaccagggatcttccttaggagggtcaaagtgcagatcagaccatgcaggtaaggtgaaccagctgcacggaccaggttcccgcaaaacattgccagctagtgaggcataatttgctcaaagtatagaaacagcccacctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagctggtatgagagaaaaaaaaaaa

SEQ ID NO: 361116 - DNA, 3285 bp, Homo sapiens
ggtttgtatccaatgtctggcacgtggttagatgctcacagatgcctgtagttgaatttcattctagtaaactagtgaaatgattcccatgaggaggtgagccagtggtaatgcccagagtcctggctctatctggttagaggttcacccctggcactgtctcatggtatcctagctggtctcgacttcctgtctggtgcagccggattagtgagaaactttccctctctactggcttctctcccttattcttatcgtgtccctaccaccagtcccttaatatgtttgccctgtgtttcccactttaccaaaggagtaggtagacaggcaagtcagattccaggtagaggatgtatagactggctagttcaagggtttgggggcagaatacctctattactttgtatgtttatatggcaggtttgcttaacaaaacaactgaaacttctctaaaaatctctctctctctctcttttaaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaacactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccttcagtggatggaacgtgagtgtctgatcatctctcttggaagttttctgaaccttccaagctctgtggtgaggacaaaccagtgtttgaatcatatgctgataactgtttgcctgtgaccctcacaccttgttcttcagggttttaatgattttctgttgacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccagtgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagggttacctcagtctttagccattactgcttatttcttttccccaagtcacaaaaaacttgtaagctgctgggttaaagcagaggccacctgtcagatctaccctacccttatttggttacatggcacctgagagtttcactcagaccagggatcttccttaggagggtcaaagtgcagatcagaccatgcaggtaaggtgaaccagctgcacggaccaggttcccgcaaaacattgccagctagtgaggcataatttgctcaaagtatagaaacagcccacctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagctggtatgagagaaaaaaaaaaa

SEQ ID NO: 361117 - DNA, 1780 bp, Homo sapiens
agcggagtcccacccttcggcgcagggctccggccaacacagccctccaggccgcctactctccagccagccggctccacggacccacggaagggcaagggggcggcgtcggggcggcgggacagttgtcggagggcgccctccaggcccaagccgccttctccggcccccgccatggcccggggcggcagtcagagctggagctccggggaatcagacgggcagccaaaggagcagacgcccgagaagcccagacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggttcccgcaaaacattgccagctagtgaggcataatttgctcaaagtatagaaacagcccacctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagctggtatgagagaaaaaaaaaaa

SEQ ID NO: 361118 - DNA, 570 bp, Homo sapiens
  misc_feature (22)..(22): n is a, c, g, or t
tacgatcgagctcggtaccganctcgacagtgtgcaggtggtggatgaaaaattgcctggcctacttggcaactttcctggcccttttgaagaggaaatgaagggtattgccgctgttactgatatacctttaggtaaagttcacttagaagctttaaaaaaaaaagtaattaaattcttttacaagtttccattgaggtgtgatatacatacagcaaagtgcacaggtcttagatatacagctcagtgaagcttcagaaatgcatgcatgcatgtagccatgactcagatcaagatacggaagagcccagcactccacgatgctccatcatgcccctttgcagaaaatactgcctcctccagtaaacactattctgatgtcactatagattagttttgcctcttcgtgaactttgtataaatagaactgaacaatatgaactgtcctgtgtgatttcttgtatttcattatgggtggtgtgctattgtatcaacagggtatttgggtggttttcagatttgtgatattaacaataaaggaattataaatattgtagtacaaaatggggg

SEQ ID NO: 361119 - DNA, 311 bp, Homo sapiens
  misc_feature (43)..(44): n is a, c, g, or t
gcggccgcctactactatctactgctcgaattcaagcttctanngatgtacggggacatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaa

SEQ ID NO: 361120 - DNA, 2361 bp, Homo sapiens
tcacgcggcgggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaa

SEQ ID NO: 361121 - DNA, 2515 bp, Homo sapiens
tcacgcggcgggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaagtgccagtcagcagtcatgcacgctgattgggtgtgtacatctgtgttggtttggaggaggggggttattatcaagaaatacaagctgaacatcgtatctgaattaaataacaagggttatgtaagtgggttattaaatatgactaaacggtca

SEQ ID NO: 361122 - DNA, 264 bp, Homo sapiens
ctcagtgagcttcagaaatgcatgcacattacctgaccaatcagatcgagacccacatcagagctcatctcccttcgaatacgctcccgtacctacgagtcacatagatattgctccggaacttgttaatatgaactgtcctgtgtgatttcttgtatttcattatgggtggtgtgctattgtatcaacagggtatttgggtggttttcagatttgtgatattaacaataaaggaattataaatattgtagtacaaaatggggg

SEQ ID NO: 361123 - DNA, 1804 bp, Homo sapiens
  misc_feature (624)..(624): n is a, c, g, or t
ataccttatggattaagaagaataacatgatgtataagtggtgtaaatttatataattattataaattattataaatgtataataaaataactagaatttcaccaaattagaaatttaatggaaataaaatacacattggatttgggtgaaaaaaacatgttgagcttaacatgttaatgttaaatgggacagaaatacaatgtgctgcctacttttgaattaaatgctaaatagcagtattatacattttgggaaaatattcaaaaaataaaataccctagaatggagtttcttggcagctctgtactaattttaatagttcttgaatctcctttttcaccttagaaattttagtcacactttaaaaatctgggcaaaatatatgtccagcaaacagccaagagccagatgtattaaatgatcatatttacgctcccaaaagaaaattcaaaatgaagcatgttgataaacattttggatgtgatgttggagaacaattgcaacctgcccagatgttcagctcgcccgaaggctgcctccttggtgacttgtttcatcttgagtctagagagtccaggctggggaagaaaaccacctccagccggccgttccagcacagcccnactggccaaagcacacactcacacaatgaaaacactgaaactttttcttaaaacaaatttttctcccattgtcatggttctgtatattaacacaaaattttcttttctcataggagagattatttcattcaatattttttatgaattatttaccatttgtacttcaatagtagcagaagacaaaaaagggtaattgtgcgctgagggagggtgggcagcatgaagcactacataaagaaaaatcttctaaatgaaattagaacttctgaaatttgggcttgctatgtaaattctgtgtatgttgcatacagctttttatttcttggtaaaattttgtgattgtactgaaaattttccttattttcagactactgtactgcctattaaagttgatttcagacatgcaaaaaacctggaagaaatgttgcagggctagaaacattcttctcttcctcatagtttacttctacccatctacatgatttgatagaagtgctcgcaggaggtgcttccttatcttcgtgtatgtcatgacatctgtccttttcttgaggcccagaacacacattctcccatcctttcccagccaggcaacccaatggataccagcctcactttcccgtatttttcctgactggttcccagagtacaaagcacaggacaacttcgctaactcaccctgatctttgacctatactctgggtataaatctgcctgtaccttacccttgagatgtcctgctctaggggatgatgcctgaagggaaacatttgatgaatcacagtaattgaggctcagatttctgtgtcctggtagaaccatgtgatagtgaaccaaaacatgaccattgattccttttcccatattctgatcttacctggaaacccgtgctctcagattttgtggggttatctggcagatagatggtgacaacagtcccatctggtgaaggcttaggatattaggatgtttcttacttcttattgtttgaagaaacagttgtgaataaaaattaatcaaaattagaggccaggcacagtggcttacacctgtaatgccagcactttgcgaggccgaggcgggcgaatcatctgaggttgggagtttgacaccagactggccaacatggtaaaaccccttctctactaaaagaaaaatacaaaaaaaaaaaaaaagtagc

SEQ ID NO: 361124 - DNA, 531 bp, Homo sapiens
cacaagaattgcttgaacctgggaggcagaggtcgcagtgagctgagatcgcaccactgcactccagtctggccaacagaacgagactctgtctcaaaaataaataaattaatcaaaactaattgtccagctttgatttagaatcttaactgctattacacgtctcttctgtctaccttcaaataggtcatctaatacatgggagaaacatggattttggagtatttcttgggtaagtaaagaacaaagggtcaggcatggtggttcacgcctgtaatcccagctttttgggaggctgacacgggtggatcacgaggtcaggagttcaagaccagcctggccaagatggtgaaaccccgtctctactaaaaacataaaaattagccaggcatggtggtgggcatctgtaatcccggctacttgggagcctgaggcagagacttttttgaacctgcgaggcggaggttgcagtgagccgagatcgcgccactgcactgcagcttgggatacagagccagactccatctcaaa

SEQ ID NO: 361125 - DNA, 513 bp, Homo sapiens
tcacgcggcgggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgcactattctgatgtcactatagattagttttgcctcttcgtgaactttgtataaatagaactgaacaatatgaactgtcctgtgtgatttcttgtatttcattatgggtggtgtgctattgtatcaacagggtatttgggtggttttcagatttgtgatattaacaataaaggaattataaatattgtagtacaaaatggggg

SEQ ID NO: 361126 - DNA, 2999 bp, Homo sapiens
cgagaacatacgcctcagggtggaagaagtttgtctttttgttgttgttcactgcttatccccagtgtcaggagacatgcttggcacattgtaggtccgcagtaaatattttttgaattaataaagaatatttctaccatctgctagcttactgttcatgcaggagctcaaatgtgctttaagcatgtgatatgtttcaaaagtcaaacttcatccttagggagaacactgtcatcttctcctcctttaaaaaaaaaaaataggaaaaaaagcaaaacaaaacatcaccttctcatttccccacctccaacaaaaagagtgttgagttttctaaagaaataatacaaatggataaaactgcaatttgttgtcctttctctcacatgcaaaaagaaaagaaaaaatactgccgagatttcggcagcgtgctgagcttcatcaaagcattaaaacaatgctgcttgagacgtcagaggctcatccaggaagtgcaacccagagggcaggatttcctgctggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttaatgaactgctgcatcgggctgggagagaaagctcgcgggtcccaccgggcctcctacccaagtctcagcgcgcttttcaccgaggcctcaattctgggatttggcagctttgctgtgaaagcccaatggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaa

SEQ ID NO: 361127 - DNA, 2588 bp, Homo sapiens
tcacgcggcgggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtaagtagagcattctcaagtgaaatgggaatctcagagcttttttatgaggaaggctggactgtgccttctggttacaaagtccaacctcttccggttcccgactggttacaaagtctaacctcttctggttcctgactggttatatagtccagcctcttccgggtcctgactggttacatagtgtcacctcttccggttcctgacattgtgttcatctcttccaggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaa

SEQ ID NO: 361128 - DNA, 3087 bp, Homo sapiens
cgagaacatacgcctcagggtggaagaagtttgtctttttgttgttgttcactgcttatccccagtgtcaggagacatgcttggcacattgtaggtccgcagtaaatattttttgaattaataaagaatatttctaccatctgctagcttactgttcatgcaggagctcaaatgtgctttaagcatgtgatatgtttcaaaagtcaaacttcatccttagggagaacactgtcatcttctcctcctttaaaaaaaaaaaataggaaaaaaagcaaaacaaaacatcaccttctcatttccccacctccaacaaaaagagtgttgagttttctaaagaaataatacaaatggataaaactgcaatttgttgtcctttctctcacatgcaaaaagaaaagaaaaaatactgccgagatttcggcagcgtgctgagcttcatcaaagcattaaaacaatgctgcttgagacgtcagaggctcatccaggaagtgcaacccagagggcaggatttcctgctggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttaatgaactgctgcatcgggctgggagagaaagctcgcgggtcccaccgggcctcctacccaagtctcagcgcgcttttcaccgaggcctcaattctgggatttggcagctttgctgtgaaagcccaatgggtaaccaacagcttggaggacccgagtggattcgattctctctcactcctcggccactcaactgctccttgtccctgactccgcgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaa

SEQ ID NO: 361129 - DNA, 2400 bp, Homo sapiens
tcacgcggcgggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaaaaaaaaaaaaaacaacactcaccacagaaaaccacacac

SEQ ID NO: 361130 - DNA, 2944 bp, Homo sapiens
cgagaacatacgcctcagggtggaagaagtttgtctttttgttgttgttcactgcttatccccagtgtcaggagacatgcttggcacattgtaggtccgcagtaaatattttttgaattaataaagaatatttctaccatctgctagcttactgttcatgcaggagctcaaatgtgctttaagcatgtgatatgtttcaaaagtcaaacttcatccttagggagaacactgtcatcttctcctcctttaaaaaaaaaaaataggaaaaaaagcaaaacaaaacatcaccttctcatttccccacctccaacaaaaagagtgttgagttttctaaagaaataatacaaatggataaaactgcaatttgttgtcctttctctcacatgcaaaaagaaaagaaaaaatactgccgagatttcggcagcgtgctgagcttcatcaaagcattaaaacaatgctgcttgagacgtcagaggctcatccaggaagtgcaacccagagggcaggatttcctgctggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttaatgaactgctgcatcgggctgggagagaaagctcgcgggtcccaccgggcctcctacccaagtctcagcgcgcttttcaccgaggcctcaattctgggatttggcagctttgctgtgaaagcccaatggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaa

SEQ ID NO: 361131 - DNA, 2942 bp, Homo sapiens
cgagaacatacgcctcagggtggaagaagtttgtctttttgttgttgttcactgcttatccccagtgtcaggagacatgcttggcacattgtaggtccgcagtaaatattttttgaattaataaagaatatttctaccatctgctagcttactgttcatgcaggagctcaaatgtgctttaagcatgtgatatgtttcaaaagtcaaacttcatccttagggagaacactgtcatcttctcctcctttaaaaaaaaaaaataggaaaaaaagcaaaacaaaacatcaccttctcatttccccacctccaacaaaaagagtgttgagttttctaaagaaataatacaaatggataaaactgcaatttgttgtcctttctctcacatgcaaaaagaaaagaaaaaatactgccgagatttcggcagcgtgctgagcttcatcaaagcattaaaacaatgctgcttgagacgtcagaggctcatccaggaagtgcaacccagagggcaggatttcctgctggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttaatgaactgctgcatcgggctgggagagaaagctcgcgggtcccaccgggcctcctacccaagtctcagcgcgcttttcaccgaggcctcaattctgggatttggcagctttgctgtgaaagcccaatggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaa

SEQ ID NO: 361132 - DNA, 1659 bp, Homo sapiens
  misc_feature (12)..(12): n is a, c, g, or t
  misc_feature (15)..(15): n is a, c, g, or t
  misc_feature (20)..(20): n is a, c, g, or t
attctagagganccnggtcntgtatacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaa

SEQ ID NO: 361133 - DNA, 2929 bp, Homo sapiens
  misc_feature (1)..(1): n is a, c, g, or t
  misc_feature (4)..(4): n is a, c, g, or t
  misc_feature (13)..(13): n is a, c, g, or t
  misc_feature (16)..(16): n is a, c, g, or t
  misc_feature (21)..(21): n is a, c, g, or t
  misc_feature (25)..(25): n is a, c, g, or t
  misc_feature (31)..(31): n is a, c, g, or t
  misc_feature (37)..(38): n is a, c, g, or t
  misc_feature (50)..(50): n is a, c, g, or t
  misc_feature (71)..(71): n is a, c, g, or t
  misc_feature (180)..(181): n is a, c, g, or t
  misc_feature (247)..(247): n is a, c, g, or t
  misc_feature (336)..(336): n is a, c, g, or t
  misc_feature (350)..(350): n is a, c, g, or t
nggngggggcggngcngcccnggancccganggggcnnacggaaaaaacngcagcccaggggcggggaatntagtaaataaacaagtcaaagacttgtggaaaataggaagtgaacccatattttaaattctcataagtagcattcatgtaataaacaggtttttagtttgttcttcagnntgatagggagttttaaagaaattttagtagttactaaaattatgttactgtatttttcagaaatcnaactgcttatgaaaagtactaatagaactgttaacctttctaaccttcacgattaactgtgaaatgtacgtcattgtgcaagaccgttngtccacttcatttngtataatcacagttgtgttcctgacactcaataaacagtcatgggaaagagtgccaaaaaaaaaaaaaaaaaaaaaaaaaaaaaaaaaaaaaaaaaaaaaaaaaaaaaaaaaccagagggcaggatttcctgctggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttaatgaactgctgcatcgggctgggagagaaagctcgcgggtcccaccgggcctcctacccaagtctcagcgcgcttttcaccgaggcctcaattctgggatttggcagctttgctgtgaaagcccaatggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaa

SEQ ID NO: 361134 - DNA, 2307 bp, Homo sapiens
tcacgcggcgggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaattaaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaa

SEQ ID NO: 361135 - DNA, 929 bp, Homo sapiens
  misc_feature (7)..(7): n is a, c, g, or t
  misc_feature (52)..(52): n is a, c, g, or t
tttgaanccctttgccagcacccgactctagaggatccccctgaataccggnattcagcaaagcatgctttgctgaataccggctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaa

SEQ ID NO: 361136 - DNA, 1466 bp, Homo sapiens
tcacgcggcgggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtaagtagagcattctcaagtgaaatgggaatctcagagcttttttatgaggaaggctggactgtgccttctggttacaaagtccaacctcttccggttcccgactggttacaaagtctaacctcttctggttcctgactggttatatagtccagcctcttccgggtcctgactggttacatagtgtcacctcttccggttcctgacattgtgttcatctcttccaggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagagcagagatatctcatttgaacatgtatgatgtcctgtcacaaaactgtctcacagctgacgatcacactgtgtgtacaagtcatcgactactgcgatgctgac

SEQ ID NO: 361137 - DNA, 1392 bp, Homo sapiens
tcacgcggcgggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtaagtagagcattctcaagtgaaatgggaatctcagagcttttttatgaggaaggctggactgtgccttctggttacaaagtccaacctcttccggttcccgactggttacaaagtctaacctcttctggttcctgactggttatatagtccagcctcttccgggtcctgactggttacatagtgtcacctcttccggttcctgacattgtgttcatctcttccaggtattctagaatggattctgggaaagaaagatgccatgtggatagggttcctcactagaacagttctggaaaatagcacaagaggtaaagtgtttcgttgctttactattaaatatttattttaaattactcatattaaaaaataaaaatatttgtcaagctccagcttaatcctttgaggaactattgcagaatttcttaagtgaacctctgacactcatgtggaattactcatgttttctttgtgcagactgtgtgttttatagcaaataaatgaattacttaaaaagcactagggatactgacattatgaaaggcacctatgaatatttttggtgtacagaaaaaaaatgacccacacacaaaag

SEQ ID NO: 361138 - DNA, 1550 bp, Homo sapiens
cgagaacatacgcctcagggtggaagaagtttgtctttttgttgttgttcactgcttatccccagtgtcaggagacatgcttggcacattgtaggtccgcagtaaatattttttgaattaataaagaatatttctaccatctgctagcttactgttcatgcaggagctcaaatgtgctttaagcatgtgatatgtttcaaaagtcaaacttcatccttagggagaacactgtcatcttctcctcctttaaaaaaaaaaaataggaaaaaaagcaaaacaaaacatcaccttctcatttccccacctccaacaaaaagagtgttgagttttctaaagaaataatacaaatggataaaactgcaatttgttgtcctttctctcacatgcaaaaagaaaagaaaaaatactgccgagatttcggcagcgtgctgagcttcatcaaagcattaaaacaatgctgcttgagacgtcagaggctcatccaggaagtgcaacccagagggcaggatttcctgctggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttaatgaactgctgcatcgggctgggagagaaagctcgcgggtcccaccgggcctcctacccaagtctcagcgcgcttttcaccgaggcctcaattctgggatttggcagctttgctgtgaaagcccaatggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggtaaagttcacttagaagctttaaaaaaaaaagtaattaaattcttttacaagtttccattgaggtgtgatatacatacagcaaagtgcacaggtcttagatatacagctcagtgaagcttcagaaatgcatgcatgcatgtagccatgactcagatcaagatacggaagagcccagcactccacgatgctccatcatgcccctttgcagaaaatactgcctcctccagtaaacactattctgatgtcactatagattagttttgcctcttcgtgaactttgtataaatagaactgaacaatatgaactgtcctgtgtgatttcttgtatttcattatgggtggtgtgctattgtatcaacagggtatttgggtggttttcagatttgtgatattaacaataaaggaattataaatattgtagtacaaaatggggg

SEQ ID NO: 361139 - DNA, 1811 bp, Homo sapiens
  misc_feature (1)..(1): n is a, c, g, or t
  misc_feature (4)..(4): n is a, c, g, or t
  misc_feature (13)..(13): n is a, c, g, or t
  misc_feature (16)..(16): n is a, c, g, or t
  misc_feature (21)..(21): n is a, c, g, or t
  misc_feature (25)..(25): n is a, c, g, or t
  misc_feature (31)..(31): n is a, c, g, or t
  misc_feature (37)..(38): n is a, c, g, or t
  misc_feature (50)..(50): n is a, c, g, or t
  misc_feature (71)..(71): n is a, c, g, or t
  misc_feature (180)..(181): n is a, c, g, or t
  misc_feature (247)..(247): n is a, c, g, or t
  misc_feature (336)..(336): n is a, c, g, or t
  misc_feature (350)..(350): n is a, c, g, or t
nggngggggcggngcngcccnggancccganggggcnnacggaaaaaacngcagcccaggggcggggaatntagtaaataaacaagtcaaagacttgtggaaaataggaagtgaacccatattttaaattctcataagtagcattcatgtaataaacaggtttttagtttgttcttcagnntgatagggagttttaaagaaattttagtagttactaaaattatgttactgtatttttcagaaatcnaactgcttatgaaaagtactaatagaactgttaacctttctaaccttcacgattaactgtgaaatgtacgtcattgtgcaagaccgttngtccacttcatttngtataatcacagttgtgttcctgacactcaataaacagtcatgggaaagagtgccaaaaaaaaaaaaaaaaaaaaaaaaaaaaaaaaaaaaaaaaaaaaaaaaaaaaaaaaaccagagggcaggatttcctgctggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttaatgaactgctgcatcgggctgggagagaaagctcgcgggtcccaccgggcctcctacccaagtctcagcgcgcttttcaccgaggcctcaattctgggatttggcagctttgctgtgaaagcccaatggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagcttacccgcccccaacccaaaaaaattttttatttgaaacccttttttaattgccctgggaaacaaaaacg

SEQ ID NO: 361140 - DNA, 969 bp, Homo sapiens
tcacgcggcgggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggtaaagttcacttagaagctttaaaaaaaaaagtaattaaattcttttacaagtttccattgaggtgtgatatacatcagcacaggtgctgtatgtcttagatatacagcacaggtgctgtatgtcttagatatacagcaaagtgcacaggtcttagatatacagctcagtgaagcttcagaaatgcatgcatgcatgtagccatgactcagatcaagatacggaagagcccagcactccacgatgctccatcatgcccctttgcagaaaatactgcctcctccagtaaacactattctgatgtcactatagattagttttgcctcttcgtgaactttgtataaatagaactgaacaatatgaactgtcctgtgtgatttcttgtatttcattatgggtggtgtgctattgtatcaacagggtatttgggtggttttcagatttgtgatattaacaataaaggaattataaatattgtagtacaaaatggggg

SEQ ID NO: 361141 - DNA, 1199 bp, Homo sapiens
cgagaacatacgcctcagggtggaagaagtttgtctttttgttgttgttcactgcttatccccagtgtcaggagacatgcttggcacattgtaggtccgcagtaaatattttttgaattaataaagaatatttctaccatctgctagcttactgttcatgcaggagctcaaatgtgctttaagcatgtgatatgtttcaaaagtcaaacttcatccttagggagaacactgtcatcttctcctcctttaaaaaaaaaaaataggaaaaaaagcaaaacaaaacatcaccttctcatttccccacctccaacaaaaagagtgttgagttttctaaagaaataatacaaatggataaaactgcaatttgttgtcctttctctcacatgcaaaaagaaaagaaaaaatactgccgagatttcggcagcgtgctgagcttcatcaaagcattaaaacaatgctgcttgagacgtcagaggctcatccaggaagtgcaacccagagggcaggatttcctgctggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttaatgaactgctgcatcgggctgggagagaaagctcgcgggtcccaccgggcctcctacccaagtctcagcgcgcttttcaccgaggcctcaattctgggatttggcagctttgctgtgaaagcccaatggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttagagagattattcacgcagatttcttactgaataagatacaagatgtacttcaatagtagcagccgacgaggttttgccactctaaa

SEQ ID NO: 361142 - DNA, 912 bp, Homo sapiens
tcacgcggcgggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggtaaagttcacttagaagctttaaaaaaaaaagtaattaaattcttttacaagtttccattgaggtgtgatatacatacagcaaagtgcacaggtcttagatatacagctcagtgaagcttcagaaatgcatgcatgcatgtagccatgactcagatcaagatacggaagagcccagcactccacgatgctccatcatgcccctttgcagaaaatactgcctcctccagtaaacactattctgatgtcactatagattagttttgcctcttcgtgaactttgtataaatagaactgaacaatatgaactgtcctgtgtgatttcttgtatttcattatgggtggtgtgctattgtatcaacagggtatttgggtggttttcagatttgtgatattaacaataaaggaattataaatattgtagtacaaaatggggg

SEQ ID NO: 361143 - DNA, 2966 bp, Homo sapiens
  misc_feature (1)..(1): n is a, c, g, or t
  misc_feature (4)..(4): n is a, c, g, or t
  misc_feature (13)..(13): n is a, c, g, or t
  misc_feature (16)..(16): n is a, c, g, or t
  misc_feature (21)..(21): n is a, c, g, or t
  misc_feature (25)..(25): n is a, c, g, or t
  misc_feature (31)..(31): n is a, c, g, or t
  misc_feature (37)..(38): n is a, c, g, or t
  misc_feature (50)..(50): n is a, c, g, or t
  misc_feature (71)..(71): n is a, c, g, or t
  misc_feature (180)..(181): n is a, c, g, or t
  misc_feature (247)..(247): n is a, c, g, or t
  misc_feature (336)..(336): n is a, c, g, or t
  misc_feature (350)..(350): n is a, c, g, or t
nggngggggcggngcngcccnggancccganggggcnnacggaaaaaacngcagcccaggggcggggaatntagtaaataaacaagtcaaagacttgtggaaaataggaagtgaacccatattttaaattctcataagtagcattcatgtaataaacaggtttttagtttgttcttcagnntgatagggagttttaaagaaattttagtagttactaaaattatgttactgtatttttcagaaatcnaactgcttatgaaaagtactaatagaactgttaacctttctaaccttcacgattaactgtgaaatgtacgtcattgtgcaagaccgttngtccacttcatttngtataatcacagttgtgttcctgacactcaataaacagtcatgggaaagagtgccaaaaaaaaaaaaaaaaaaaaaaaaaaaaaaaaaaaaaaaaaaaaaaaaaaaaaaaaaccagagggcaggatttcctgctggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttaatgaactgctgcatcgggctgggagagaaagctcgcgggtcccaccgggcctcctacccaagtctcagcgcgcttttcaccgaggcctcaattctgggatttggcagctttgctgtgaaagcccaatggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaa

SEQ ID NO: 361144 - DNA, 2432 bp, Homo sapiens
  misc_feature (2398)..(2398): n is a, c, g, or t
  misc_feature (2400)..(2400): n is a, c, g, or t
  misc_feature (2418)..(2418): n is a, c, g, or t
  misc_feature (2420)..(2421): n is a, c, g, or t
  misc_feature (2427)..(2427): n is a, c, g, or t
tcacgcggcgggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaaaaaaaaaaaaaaaaaaaaaaaaaaaaaaaaaaaaaananaaaaaaaaaaaaaaaaanannaaaaanaaaag

SEQ ID NO: 361145 - DNA, 2366 bp, Homo sapiens
gtgcgaattcatcatcctgctgcgcgaattcatcatcctgctgcgcgagattcatcatcctgctgcgcgaattcatcatcctgctgcgcgaattcatcatcctgctgcgcgaattcatcatcctgctgcgcgattcatctcctgctcagctgtgccatcgcgcagcacgcgccggcgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaa

SEQ ID NO: 361146 - DNA, 2244 bp, Homo sapiens
  misc_feature (9)..(9): n is a, c, g, or t
  misc_feature (169)..(169): n is a, c, g, or t
  misc_feature (190)..(190): n is a, c, g, or t
acccccccnccccccccccgccacccccccccccccccccccccccccccccgccccccccccccccccccccccccccccccccccccccccccccccccccccccgtcccccccccccctcccccccccccccccccccccccccccccccccccccccctcccctnccccctctcccccccccaccngtgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaa

SEQ ID NO: 361147 - DNA, 2380 bp, Homo sapiens
tcacgcggcgggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttccaatgactgtttattgagtgtcaggaacacaactgtgattatacaaaatgaagtggacaaacggtcttgcacaaatgacgtacatttcacagttaatcgtgaaggttagaaaggttaacaagttgtcgacc

SEQ ID NO: 361148 - DNA, 2324 bp, Homo sapiens
tcacgcggcgggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaa

SEQ ID NO: 361149 - DNA, 2267 bp, Homo sapiens
tcacgcggcgggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaa

SEQ ID NO: 361150 - DNA, 2058 bp, Homo sapiens
tcacgcggcgggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttccccaagtaccctcagtatattagctaactctcaagtaacagcatttcacgcctgcagtagattctagagatcaccgcatacac

SEQ ID NO: 361151 - DNA, 1412 bp, Homo sapiens
tcacgcggcgggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaacttgcatagatggtcacccaaaaggtccaaattccgaaaactttacctggcgggacttggcccttgacgcccttgtcatcagggtcgggaagaagcacaacagtactggccatacaagcaatggacgggcctcctggagaccattgaaccgacaaacactctccaattgttgacacggacaacacttggacagattgtacctgg

SEQ ID NO: 361152 - DNA, 1165 bp, Homo sapiens
tcacgcggcgggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagaggtaaagtgtttcgttgctttactattaaatatttattttaaattactcatattaaaaaataaaaatatttgtcaagctccagcttaatcctttgaggaactattgcagaatttcttaagtgaacctctgacactcatgtggaattactcatgttttctttgtgcagactgtgtgttttatagcaaataaatgaattacttaaaaagcactagggatactgacattatgaaaggcacctatgaatatttttggtgtacagaaaaaaaatgacccacacacaaaag

SEQ ID NO: 361153 - DNA, 746 bp, Homo sapiens
  misc_feature (726)..(726): n is a, c, g, or t
tcacgcggcgggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggtaaagttcacttagaagctttaaaaaaaaaagtaattaaattcttttacaagtttccattgaggtgtgatatacatacagcaaagtgcacaggtcttagatatacagctcagtgaagcttcagaaatgcatgcatgcatgtagccatgactcagatcaagatacggaagagcccagcactccacgatgctccatcatgcccctttgcagaaaatactgcctcctccagtaaacagctacctttccggtnccgagctcgagtcgtatcat

SEQ ID NO: 361154 - DNA, 1107 bp, Homo sapiens
tcacgcggcgggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggtaaagttcacttagaagctttaaaaaaaaaagtaattaaattcttttacaagtttccattgaggtgtgatatacatacagcaaagtgcacaggtcttagatatacagctcagtgaagcttcagaaatgcatgcatgcatgtagccatgactcagatcaagatacggaagagcccagcactccacgatgctccatcatgcccctttgcagaaaatactgcctcctccagtaaacactattctgatgtcactatagattagttttgcctcttcgtgaactttgtataaatagaactgaacaaacaaaaaaaaaaaaaaaaaaaaaaaaacaaacaagagagacacaccaacacacacacaacagacaaacaccaccaacccacacgacaaacagagcgagcgacgacaaccaaattatttaatttaataacaacacaaataaaccactaaaaatacaatatactcacacccaaactaacaataaccaacacgtacacttaacgcaagggacgaaggaagagagggcggaagacaatgacaacacagagaaggaagagaagtagaagagagagaataaacgagagcacggaggagggggagaaatacgagaaaaggtactggggaggaaaggc

SEQ ID NO: 361155 - DNA, 1543 bp, Homo sapiens
tcacgcggcgggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaagggtaattgtgcgctgagggagggtgggcagcatgaagcactacataaagaaaaatcttctaaatgaaattagaacttctgaaatttgggcttgctatgtaaattctgtgtatgttgcatacagctttttatttcttggtaaaattttgtgattgtactgaaaattttccttattttcagactactgtactgcctattaaagttgatttcagacatgcaaaaaacctggaagaaatgttgcagggctagaaacattcttctcttcctcatagtttacttctacccatctacatgatttgatagaagtgctcgcaggaggtgcttccttatcttcgtgtatgtcatgacatctgtccttttcttgaggcccagaacacacattctcccatcctttcccagccaggcaacccaatggataccagcctcactttcccgtatttttcctgactggttcccagagtacaaagcacaggacaacttcgctaactcaccctgatctttgacctatactctgggtataaatctgcctgtaccttacccttgagatgtcctgctctaggggatgatgcctgaagggaaacatttgatgaatcacagtaattgaggctcagatttctgtgtcctggtagaaccatgtgatagtgaaccaaaacatgaccattgattccttttcccatattctgatcttacctggaaacccgtgctctcagattttgtggggttatctggcagatagatggtgacaacagtcccatctggtgaaggcttaggatattaggatgtttcttacttcttattgtttgaagaaacagttgtgaataaaaattaatcaaaattagaggccaggcacagtggcttacacctgtaatgccagcactttgcgaggccgaggcgggcgaatcatctgaggttgggagtttgacaccagactggccaacatggtaaaaccccttctctactaaaagaaaaatacaaaaaaaaaaaaaaagtagc

SEQ ID NO: 361156 - DNA, 405 bp, Homo sapiens
cctgttctagatgattaggatagagccatgaacaccaacaaagacaaagctgtgctctgttttcattatataatgtcaggtggtgataaggactaggaagaaaataaagtgatgcaggggagtagggaggtagagtggatggctatttagatagagtggcttctcccttgaggtggcatttaaacagagctctgcctgtgaagccattgacttcttcacaacagaaagcttctgttggggaagggtaggagagcagtaacaattcaggaatatttttaaagtacctactgtgtgcttcatgctggggaccgagaagttgaacaaaactggaaaattgttagcattctctgatttttattctagagtctgtgcaagacccagacaataaagaactaccagaaaaaa

SEQ ID NO: 361157 - DNA, 489 bp, Homo sapiens
tttgttagataattctagtatctctgtcatgtcagtgttggcacctattggttatatttttagataagttaagatttttcttgttcttactatgatgaatgtttttttatcaaaacctggacatttgggtattgtgttatgggactctggatcttatttaagccttctgttttagctggcttcttctaataccactctggctggtggtgagggagccacctctttattaatgccaggtgtggtagaaatccaggttccccactcagcatccattaacatcctcaggacagaaagggctcctcattagtgccgggtgtaggtgggaattctggctccccatgttgcctccactgataccacaagcattggagtagccttgttacttttgagcactggaaaaagtcttattatctccactagagctactctgacaccatcccagtggagaaggggaagggtgccccattaacagaagtggaagtccagact

SEQ ID NO: 361158 - DNA, 1767 bp, Homo sapiens
cccggcacgaggagctcccgcccgcccgcggccgcccgggagctcgtccagccccgcgctgcgctcgcccgcccgctgcccgccggagcaccgcggcctccgcccgcgtccatctgcccgccgcccgcgcctgttccgcagcccgcgtccgcgccggccccacagctctgcgtccgggtattactcagcacagaaattcaggagacacagacaagttcttccacgatgtcgtacagacgagaactagagaaataccgtgacctggatgaagatgaaatccttggagccctaacagaggaagagctgaggaccctggaaaatgagctggatgagctggaccctgataatgcactgctgcctgcaggcctgaggcagaaggatcagaccaccaaggcgcccacgggcccctttaaaagagaggagctcttggatcacttggaaaagcaagcaaaggagtttaaggaccgagaagatctggtcccctacacaggggaaaaacgaggaaaggtctgggttcctaagcagaagccactggatcctgtgctggaaagtgtgacgctggaaccggagctggaggaagccttggcaaatgcttcagatgcagaactctgtgacattgcagcgatcctgggcatgcacacgctcatgagtaaccagcagtactaccaggccctgagcagcagctccatcatgaacaaggaggggctcaacagcgtgattaaacccacacaatacaagcctgtgcccgacgaagaaccaaattcaacagacgtagaggaaacgctggaacggataaagaacaacgacccaaaacttgaagaagttaacctcaataatatccggaatatccccatccccaccctcaaggcatatgcagaagccctgaaagaaaactcatatgtgaagaagttcagcatcgtggggacacggagtaatgaccccgtggcgtatgcccttgctgagatgctcaaggagaacaaggtgttgaagacactgaatgtggaatccaacttcatttctggagctgggattctgcgcctggtagaagccctcccatacaacacttctctggtggaaatgaaaattgacaaccagagccagcccctgggcaacaaagtggaaatggagattgtgagcatgttggaaaaaaacgcaacacttctcaaattcggctaccactttacccagcaaggaccccggcttcgggcatccaacgcaatgatgaacaacaatgaccttgtgaggaagaggaggcttgcggacctgactgggcccatcattcccaagtgccggagtggtgtctagtgtgtggcggtggagtccatgcctttgaactggatgtgttctattgatgacctgtgctctgcaggggaaaccagaaggcaaaatgctggcagcatgaaacccttttgtggttcagttctttatgcactaaggttttaggttgactagtggttgtagttgaaaattttataaaataccgttaatgtgaagtttttctttagtcacagaagttgaatctggttattatttaaaaactagaagcccccaaaccagcagatcttactgaagatgatgttccagcagcagcgacttagccccaggagcccagtttcaatggccttgctgtgtggtgtttcaagtgcatttaaaatgtgtgacacagaaacggcacactcttccacatgcttttgaagtattataaaacactttattacaaatttgtcttagctattagcaaataaaactgattatcattctttatta

SEQ ID NO: 361159 - DNA, 2823 bp, Homo sapiens
agcggagcgccgggaaagatggcggcgtctgtggtttgaattccagcggcgccgccagagtctgaacaagagctggggtggagggggcggggacctggggagcccggcgggtcgctatcgcggggggtactagtggcgccgccgccacagacaccaacgccgtcgccacctctgtatccatgatggacttggtgttggaagaggacgtcaccgtcgctgggacgctcagcggctgcagtggccttgttcccagtgtaccagaaaactcatatgtgaagaagttcagcatcgtggggacacggagtaatgaccccgtggcgtatgcccttgctgagatgctcaaggagaacaaggtgttgaagacactgaatgtggaatccaacttcatttctggagctgggattctgcgcctggtagaagccctcccatacaacacttctctggtggaaatgaaaattgacaaccagagccagcccctgggcaacaaagtggaaatggagattgtgagcatgttggaaaaaaacgcaacacttctcaaattcggctaccactttacccagcaaggaccccggcttcgggcatccaacgcaatgatgaacaacaatgaccttgtgaggaagaggaggcttgcggacctgactgggcccatcattcccaagtgccggagtggtgtctagtgtgtggcggtggagtccatgcctttgaactggatgtgttctattgatgacctgtgctctgcaggggaaaccagaaggcaaaatgctggcagcatgaaacccttttgtggttcagttctttatgcactaaggttttaggttgactagtggttgtagttgaaaattttataaaataccgttaatgtgaagtttttctttagtcacagaagttgaatctggttattatttaaaaactagaagcccccaaaccagcagatcttactgaagatgatgttccagcagcagcgacttagccccaggagcccagtttcaatggccttgctgtgtggtgtttcaagtgcatttaaaatgtgtgacacagaaacggcacactcttccacatgcttttgaagtattataaaacactttattacaaatttgtcttagctattagcaaataaaactgattatcattctttattaaccctccttggaattttgaaaacctcgattaaagttgccaaattgattactggatccagaacacaattttcccctcagaacagatagacagactgaagccactgaactctgccaggagtcaacatgagattccttttgctggatatgcagaaatgataggaaaaaaaccaatggtgaaatttcaagtttcaaaaaccaacctttcattaccaatcccaggcaacaaacatgtccctgagtgttctttaagaacatttgggatttatgtacaatttaatactggagttagaactttttccttattgaatgccaaccttatgatggatgtgaaaatctacggccaaatacttttgaaaacacctttctatattgcacagtgggcaaatggcttatgtgaggtaagacactagagggataaatttccagatcaacatggctatggtatttagtaatggcccagcttagagacttcagctactgatctcatcacttattagacaaattgctgctgaccttacgcctgtatattaagcctccgcaggatgccggacaatggtgaagaaactccagatatcaaggaattgggaaatcctggccaaaccaccccaagatgattacactgaaatgtagtattagtactgctgccagatctctttttaacatcatgtgcgtctcttgggatccagcaaaagtgttaagccacaatgcccttgtgccttttaatataccacagtgccagttaaactaatatttttgtttgttgcttttgggagttattttcattagtgatttcagcaaatctcatgataaaggacaaggtcaagaactccagagcactgagcagagaggctggtgatgaaaaggtgaaggcctgcgcactgaactgtaaggcagtgggcagtacagggtaactggaggcggggccagggcctcagcgctatggaagagtgtccactgaggctgcacatggcccaggagtggcaccatgttgcagggacaaccatccccatttggcttctccttaaaacacaattgcagctgcattctgcatcgctgaaaactgcaatataatattaaatctgttggtctatgcatggctgcgtatgtgtttcttggaacctgtgtgacagggacatgtgcctggcacactggccagaagactgggcagccaccatggcagtgctggatgacctcagtaagaatgtgtcatgtattccaggtgctgatctaaaaactgtggctcaaatgtcaccgagcttatatgaagctcccagagagaacatttaaaagctcagagagtaagtgctggggaaagcagagctatcagaggaaatctctcatagaaacgaaaccaaaccaacagaaaatgaagaaggccacatctttaaggccacctctgcctctatcagatgagctgctggtctagatcaggggctggcaaacttttctgtaaaaggccagacagtaaaaatttccgattttgcaggccacatagtgtctgttgcaactattcaactctgccatagatcatgtgtaaaggaatgggtgtggctgttcaataaactatacagttgacccttgaacaatatgggtttgaactgcatggctgcacttatatatggatttttttcaaccatacaggttgaaaatacagtattggcagggggcgaaacctgcgtacatg

SEQ ID NO: 361160 - DNA, 3453 bp, Homo sapiens
  misc_feature (2835)..(2835): n is a, c, g, or t
  misc_feature (2837)..(2838): n is a, c, g, or t
  misc_feature (2848)..(2848): n is a, c, g, or t
  misc_feature (2853)..(2853): n is a, c, g, or t
  misc_feature (2856)..(2856): n is a, c, g, or t
  misc_feature (2859)..(2859): n is a, c, g, or t
  misc_feature (2864)..(2864): n is a, c, g, or t
  misc_feature (2870)..(2870): n is a, c, g, or t
  misc_feature (2876)..(2876): n is a, c, g, or t
  misc_feature (2883)..(2883): n is a, c, g, or t
  misc_feature (2885)..(2885): n is a, c, g, or t
  misc_feature (2890)..(2891): n is a, c, g, or t
  misc_feature (2895)..(2895): n is a, c, g, or t
  misc_feature (2897)..(2897): n is a, c, g, or t
  misc_feature (2901)..(2901): n is a, c, g, or t
  misc_feature (2903)..(2903): n is a, c, g, or t
  misc_feature (2924)..(2924): n is a, c, g, or t
  misc_feature (2926)..(2927): n is a, c, g, or t
cccggcacgaggagctcccgcccgcccgcggccgcccgggagctcgtccagccccgcgctgcgctcgcccgcccgctgcccgccggagcaccgcggcctccgcccgcgtccatctgcccgccgcccgcgcctgttccgcagcccgcgtccgcgccggccccacagctctgcgtccgggtattactcagcacagaaattcaggagacacagacaagttcttccacgatgtcgtacagacgagaactagagaaataccgtgacctggatgaagatgaaatccttggagccctaacagaggaagagctgaggaccctggaaaatgagctggatgagctggaccctgataatgcactgctgcctgcaggcctgaggcagaaggatcagaccaccaaggcgcccacgggcccctttaaaagagaggagctcttggatcacttggaaaagcaagcaaaggagtttaaggaccgagaagatctggtcccctacacaggggaaaaacgaggaaaggtctgggttcctaagcagaagccactggatcctgtgctggaaagtgtgacgctggaaccggagctggaggaagccttggcaaatgcttcagatgcagaactctgtgacattgcagcgatcctgggcatgcacacgctcatgagtaaccagcagtactaccaggccctgagcagcagctccatcatgaacaaggaggggctcaacagcgtgattaaacccacacaatacaagcctgtgcccgacgaagaaccaaattcaacagacgtagaggaaacgctggaacggataaagaacaacgacccaaaacttgaagaagttaacctcaataatatccggaatatccccatccccaccctcaaggcatatgcagaagccctgaaagaaaactcatatgtgaagaagttcagcatcgtggggacacggagtaatgaccccgtggcgtatgcccttgctgagatgctcaaggagaacaaggtgttgaagacactgaatgtggaatccaacttcatttctggagctgggattctgcgcctggtagaagccctcccatacaacacttctctggtggaaatgaaaattgacaaccagagccagcccctgggcaacaaagtggaaatggagattgtgagcatgttggaaaaaaacgcaacacttctcaaattcggctaccactttacccagcaaggaccccggcttcgggcatccaacgcaatgatgaacaacaatgaccttgtgaggaagaggaggcttgcggacctgactgggcccatcattcccaagtgccggagtggtgtctagtgtgtggcggtggagtccatgcctttgaactggatgtgttctattgatgacctgtgctctgcaggggaaaccagaaggcaaaatgctggcagcatgaaacccttttgtggttcagttctttatgcactaaggttttaggttgactagtggttgtagttgaaaattttataaaataccgttaatgtgaagtttttctttagtcacagaagttgaatctggttattatttaaaaactagaagcccccaaaccagcagatcttactgaagatgatgttccagcagcagcgacttagccccaggagcccagtttcaatggccttgctgtgtggtgtttcaagtgcatttaaaatgtgtgacacagaaacggcacactcttccacatgcttttgaagtattataaaacactttattacaaatttgtcttagctattagcaaataaaactgattatcattctttattaaccctccttggaattttgaaaacctcgattaaagttgccaaattgattactggatccagaacacaattttcccctcagaacagatagacagactgaagccactgaactctgccaggagtcaacatgagattccttttgctggatatgcagaaatgataggaaaaaaaccaatggtgaaatttcaagtttcaaaaaccaacctttcattaccaatcccaggcaacaaacatgtccctgagtgttctttaagaacatttgggatttatgtacaatttaatactggagttagaactttttccttattgaatgccaaccttatgatggatgtgaaaatctacggccaaatacttttgaaaacacctttctatattgcacagtgggcaaatggcttatgtgaggtaagacactagagggataaatttccagatcaacatggctatggtatttagtaatggcccagcttagagacttcagctactgatctcatcacttattagacaaattgctgctgaccttacgcctgtatattaagcctccgcaggatgccggacaatggtgaagaaactccagatatcaaggaattgggaaatcctggccaaaccaccccaagatgattacactgaaatgtagtattagtactgctgccagatctctttttaacatcatgtgcgtctcttgggatccagcaaaagtgttaagccacaatgcccttgtgccttttaatataccacagtgccagttaaactaatatttttgtttgttgcttttgggagttattttcattagtgatttcagcaaatctcatgataaaggacaaggtcaagaactccagagcactgagcagagaggctggtgatgaaaaggtgaaggcctgcgcactgaactgtaaggcagtgggcagtacagggtaactggaggcggggccagggcctcagcgctatggaagagtgtccactgaggctgcacatggcccaggagtggcaccatgttgcagggacaaccatccccatttggcttctccttaaaacacaattgcagctgcattctgcatcgcccaacaccgcaacncnntcccaacccngttgnccnacncatgnctcgcntatctnccccccngnccccnngtcncnggcncntcgcccccgcccccccgcccngnnccccgcgcccccaccatggcagtgctggatgacctcagtaagaatgtgtcatgtattccaggtgctgatctaaaaactgtggctcaaatgtcaccgagcttatatgaagctcccagagagaacatttaaaagctcagagagtaagtgctggggaaagcagagctatcagaggaaatctctcatagaaacgaaaccaaaccaacagaaaatgaagaaggccacatctttaaggccacctctgcctctatcagatgagctgctggtctagatcaggggctggcaaacttttctgtaaaaggccagacagtaaaaatttccgattttgcaggccacatagtgtctgttgcaactattcaactctgccatagatcatgtgtaaaggaatgggtgtggctgttcaataaactatacagttgacccttgaacaatatgggtttgaactgcatggctgcacttatatatggatttttttcaaccatacaggttgaaaatacagtattggcagggggcgaaacctgcgtacatg

SEQ ID NO: 361161 - DNA, 2824 bp, Homo sapiens
cccggcacgaggagctcccgcccgcccgcggccgcccgggagctcgtccagccccgcgctgcgctcgcccgcccgctgcccgccggagcaccgcggcctccgcccgcgtccatctgcccgccgcccgcgcctgttccgcagcccgcgtccgcgccggccccacagctctgcgtccgggtattactcagcacagaaattcaggagacacagacaagttcttccacgatgtcgtacagacgagaactagagaaataccgtgacctggatgaagatgaaatccttggagccctaacagaggaagagctgaggaccctggaaaatgagctggatgagctggaccctgataatgcactgctgcctgcaggcctgaggcagaaggatcagaccaccaaggcgcccacgggcccctttaaaagagaggagctcttggatcacttggaaaagcaagcaaaggagtttaaggaccgagaagatctggtcccctacacaggggaaaaacgaggaaaggtctgggttcctaagcagaagccactggatcctgtgctggaaagtgtgacgctggaaccggagctggaggaagccttggcaaatgcttcagatgcagaactctgtgacattgcagcgatcctgggcatgcacacgctcatgagtaaccagcagtactaccaggccctgagcagcagctccatcatgaacaaggaggggctcaacagcgtgattaaacccacacaatacaagcctgtgcccgacgaagaaccaaattcaacagacgtagaggaaacgctggaacggataaagaacaacgacccaaaacttgaagaagttaacctcaataatatccggaatatccccatccccaccctcaaggcatatgcagaagccctgaaagaaaactcatatgtgaagaagttcagcatcgtggggacacggagtaatgaccccgtggcgtatgcccttgctgagatgctcaaggagaacaaggtgttgaagacactgaatgtggaatccaacttcatttctggagctgggattctgcgcctggtagaagccctcccatacaacacttctctggtggaaatgaaaattgacaaccagagccagcccctgggcaacaaagtggaaatggagattgtgagcatgttggaaaaaaacgcaacacttctcaaattcggctaccactttacccagcaaggaccccggcttcgggcatccaacgcaatgatgaacaacaatgaccttgtgaggaagaggaggcttgcggacctgactgggcccatcattcccaagtgccggagtggtgtctagtgtgtggcggtggagtccatgcctttgaactggatgtgttctattgatgacctgtgctctgcaggggaaaccagaaggcaaaatgctggcagcatgaaacccttttgtggttcagttctttatgcactaaggttttaggttgactagtggttgtagttgaaaattttataaaataccgttaatgtgaagtttttctttagtcacagaagttgaatctggttattatttaaaaactagaagcccccaaaccagcagatcttactgaagatgatgttccagcagcagcgacttagccccaggagcccagtttcaatggccttgctgtgtggtgtttcaagtgcatttaaaatgtgtgacacagaaacggcacactcttccacatgcttttgaagtattataaaacactttattacaaatttgtcttagctattagcaaataaaactgattatcattctttattaaccctccttggaattttgaaaacctcgattaaagttgccaaattgattactggatccagaacacaattttcccctcagaacagatagacagactgaagccactgaactctgccaggagtcaacatgagattccttttgctggatatgcagaaatgataggaaaaaaaccaatggtgaaatttcaagtttcaaaaaccaacctttcattaccaatcccaggcaacaaacatgtccctgagtgttctttaagaacatttgggatttatgtacaatttaatactggagttagaactttttccttattgaatgccaaccttatgatggatgtgaaaatctacggccaaatacttttgaaaacacctttctatattgcacagtgggcaaatggcttatgtgaggtaagacactagagggataaatttccagatcaacatggctatggtatttagtaatggcccagcttagagacttcagctactgatctcatcacttattagacaaattgctgctgaccttacgcctgtatattaagcctccgcaggatgccggacaatggtgaagaaactccagatatcaaggaattgggaaatcctggccaaaccaccccaagatgattacactgaaatgtagtattagtactgctgccagatctctttttaacatcatgtgcgtctcttgggatccagcaaaagtgttaagccacaatgcccttgtgccttttaatataccacagtgccagttaaactaatatttttgtttgttgcttttgggagttattttcattagtgacaggctgacttctgtagattaaaagtctagtatgtttagcctttatttttagatttctgtacataagatgcctgttgataggttataatcttcagtagctcagagcatgtattatcacagcacatggtaggcatgcagacatatttgttgaaagagggcaggtatgtgaagaatgccatcattgaattcacttccttctttgcttgtcaaaaggctactcctgatggggtcaggccatcagcaagtggcttttaagcggccttgtacg

SEQ ID NO: 361162 - DNA, 483 bp, Homo sapiens
ggggtatagcccggacagcagggttttaaaagtctccttaggactagatgattgaatgtcctccttcaaatactcttctgtcgtggagctcttacttgggcacctgctcagagagaggctgttgtaaagcagtgaaaagatctgttcttggcatccagcagacctgaatttgaatcccagctcatttgctcctggccgtgtgacctttcaacttctctaaacttccatttccctactcttggagaggaggctaaaatcccctcccactactcaagagtttctgcaggtagaggtggtttaggcactgtacacatggaatgagtggtgattttattttttattttttattttttcttgactaaagagccagcccctgggcaacaaagtggaaatggagattgtgagcatgttggaaaaaaacgcaacacttctcaaattcggctaccactttacccagcaaggaccccggcttcgggcatccaa

SEQ ID NO: 361163 - DNA, 3451 bp, Homo sapiens
cccggcacgaggagctcccgcccgcccgcggccgcccgggagctcgtccagccccgcgctgcgctcgcccgcccgctgcccgccggagcaccgcggcctccgcccgcgtccatctgcccgccgcccgcgcctgttccgcagcccgcgtccgcgccggccccacagctctgcgtccgggtattactcagcacagaaattcaggagacacagacaagttcttccacgatgtcgtacagacgagaactagagaaataccgtgacctggatgaagatgaaatccttggagccctaacagaggaagagctgaggaccctggaaaatgagctggatgagctggaccctgataatgcactgctgcctgcaggcctgaggcagaaggatcagaccaccaaggcgcccacgggcccctttaaaagagaggagctcttggatcacttggaaaagcaagcaaaggagtttaaggaccgagaagatctggtcccctacacaggggaaaaacgaggaaaggtctgggttcctaagcagaagccactggatcctgtgctggaaagtgtgacgctggaaccggagctggaggaagccttggcaaatgcttcagatgcagaactctgtgacattgcagcgatcctgggcatgcacacgctcatgagtaaccagcagtactaccaggccctgagcagcagctccatcatgaacaaggaggggctcaacagcgtgattaaacccacacaatacaagcctgtgcccgacgaagaaccaaattcaacagacgtagaggaaacgctggaacggataaagaacaacgacccaaaacttgaagaagttaacctcaataatatccggaatatccccatccccaccctcaaggcatatgcagaagccctgaaagaaaactcatatgtgaagaagttcagcatcgtggggacacggagtaatgaccccgtggcgtatgcccttgctgagatgctcaaggagaacaaggtgttgaagacactgaatgtggaatccaacttcatttctggagctgggattctgcgcctggtagaagccctcccatacaacacttctctggtggaaatgaaaattgacaaccagagccagcccctgggcaacaaagtggaaatggagattgtgagcatgttggaaaaaaacgcaacacttctcaaattcggctaccactttacccagcaaggaccccggcttcgggcatccaacgcaatgatgaacaacaatgaccttgtgaggaagaggaggcttgcggacctgactgggcccatcattcccaagtgccggagtggtgtctagtgtgtggcggtggagtccatgcctttgaactggatgtgttctattgatgacctgtgctctgcaggggaaaccagaaggcaaaatgctggcagcatgaaacccttttgtggttcagttctttatgcactaaggttttaggttgactagtggttgtagttgaaaattttataaaataccgttaatgtgaagtttttctttagtcacagaagttgaatctggttattatttaaaaactagaagcccccaaaccagcagatcttactgaagatgatgttccagcagcagcgacttagccccaggagcccagtttcaatggccttgctgtgtggtgtttcaagtgcatttaaaatgtgtgacacagaaacggcacactcttccacatgcttttgaagtattataaaacactttattacaaatttgtcttagctattagcaaataaaactgattatcattctttattaaccctccttggaattttgaaaacctcgattaaagttgccaaattgattactggatccagaacacaattttcccctcagaacagatagacagactgaagccactgaactctgccaggagtcaacatgagattccttttgctggatatgcagaaatgataggaaaaaaaccaatggtgaaatttcaagtttcaaaaaccaacctttcattaccaatcccaggcaacaaacatgtccctgagtgttctttaagaacatttgggatttatgtacaatttaatactggagttagaactttttccttattgaatgccaaccttatgatggatgtgaaaatctacggccaaatacttttgaaaacacctttctatattgcacagtgggcaaatggcttatgtgaggtaagacactagagggataaatttccagatcaacatggctatggtatttagtaatggcccagcttagagacttcagctactgatctcatcacttattagacaaattgctgctgaccttacgcctgtatattaagcctccgcaggatgccggacaatggtgaagaaactccagatatcaaggaattgggaaatcctggccaaaccaccccaagatgattacactgaaatgtagtattagtactgctgccagatctctttttaacatcatgtgcgtctcttgggatccagcaaaagtgttaagccacaatgcccttgtgccttttaatataccacagtgccagttaaactaatatttttgtttgttgcttttgggagttattttcattagtgatttcagcaaatctcatgataaaggacaaggtcaagaactccagagcactgagcagagaggctggtgatgaaaaggtgaaggcctgcgcactgaactgtaaggcagtgggcagtacagggtaactggaggcggggccagggcctcagcgctatggaagagtgtccactgaggctgcacatggcccaggagtggcaccatgttgcagggacaaccatccccatttggcttctccttaaaacacaattgcagctgcattctgcatcgctgaaaactgcaatataatattaaatctgttggtctatgcatggctgcgtatgtgtttcttggaacctgtgtgacagggacatgtgcctggcacactggccagaagactgggcagccaccatggcagtgctggatgacctcagtaagaatgtgtcatgtattccaggtgctgatctaaaaactgtggctcaaatgtcaccgagcttatatgaagctcccagagagaacatttaaaagctcagagagtaagtgctggggaaagcagagctatcagaggaaatctctcatagaaacgaaaccaaaccaacagaaaatgaagaaggccacatctttaaggccacctctgcctctatcagatgagctgctggtctagatcaggggctggcaaacttttctgtaaaaggccagacagtaaaaatttccgattttgcaggccacatagtgtctgttgcaactattcaactctgccatagatcatgtgtaaaggaatgggtgtggctgttcaataaactatacagttgacccttgaacaatatgggtttgaactgcatggctgcacttatatatggatttttttcaaccatacaggttgaaaatacagtattggcagggggcgaaacctgcgtacatg

SEQ ID NO: 361164 - DNA, 3414 bp, Homo sapiens
agaggccgaaaaagtacagccccttccgggctccgcggtacgggaagacagctttgggatgtcggaagatcctagaggtcccaaggtagctgacttgcgaagctgaggctccagccgagggctccaggcctctgaccggcccagcagtgagcgcggctgcccgacgcttcagggccgggagcagggagcgtgagtcgccatggcgacgccggcgggtctggagcgctgggttcaggacgagctgcactcggtgttggggctgagcgagcggcacgtcgcccagtttctgatcggtaccgcacagcgctgcacctctgccgaggagttcgtgcagcgcctacgagacactgataccttggatctcagtgggccggcccgggacttcgccctgagactctggaacaaggtaccacgaaaggcagtggtagaaaagccagctcgggcagcagagcgagaggcccgggccctgctggagaagaaccgatcttataggttactggaagacagtgaagagagcagtgaggagactgtgagtagggctggaagcagcctccagaagaaacgtaaaaagcggaaacacctcaggaagaagcgtgaggaagaagaggaggaagaggcttctgagaaagggaagaagaaaacaggggggagtaaacagcagacagagaagccagagtcggaagatgagtgggaacggacagagcgtgaacgccttcaggacctggaggagcgtgatgcctttgctgagcgggttcgacagcgggacaaggatcggactcgaaatgtcctggaacggtcagacaagaaggcttatgaagaggctcagaagcgcctcaagatggccgaggaagaccggaaggccatggtccctgagctgcggaagaaatctcgccgagagtacctggctaagcgggagcgagagaagcttgaggacctggaggcggagctggctgatgaggagttcctttttggggacgtggagctgagccggcacgagcggcaggagctcaaatataagcggcgagtgcgggatctcgcccgggagtaccgggcagctggggagcaggagaagctggaggccaccaatcgctaccacatgcccaaggaaacccgaggacagccagcccgagctgtggatctagtggaggaggaatcaggagcccctggggaggagcagcggcgctgggaggaggcgcggcttggggcagcgtccctgaagtttggggcccgagatgctgcctctcaggagcccaagtatcaactggtgctggaggaggaggagaccattgagtttgtccgggccactcagctccagggtgatgaggagccgtcagctccacccacttcaactcaggcccagcagaaagagtccatccaggccgtccgccgcagcctcccggtgttcccatttcgagaggagctcctggctgctattgcaaatcaccaagtcctcatcattgaaggcgagacaggctcagggaagaccacccagatcccgcagtatctctttgaggagggttatacaaacaagggtatgaagattgcctgcacccaaccccggagagtggctgccatgagtgtggccgcccgagtggcccgggagatgggtgtgaagcttgggaatgaggttggctacagcatccgctttgaggactgcacatcagagcgaactgtcctccgctacatgacagatgggatgcttctccgggagttcctctctgagcctgacctggcgagttacagcgtggtgatggtggatgaggcacacgaaaggaccctacacacagacattctctttggattgatcaaggatgttgctcgcttccgacctgagctcaaggtcctggtggcttcagccacaatggacactgcccgtttttccaccttctttgatgacgcccctgtgtttcgaatccccggacgcaggtttcctgtggacatcttctacaccaaggctccagaggctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaaggtggttgtggcaacgaacattgctgagacatcactcaccattgagggcatcatttatgtgctggatccagggttctgtaagcagaagagctacaacccccgcacaggcatggaatcgctcactgtcacaccctgcagcaaggcctcagccaatcagcgagctggcagggcaggtcgggtggctgcagggaagtgcttccgcctgtataccgcctgggcctatcagcacgagcttgaggaaaccacagtgcctgagatccagaggaccagcttgggcaatgtcgtgttgctgctcaagagcttagggatccatgacctaatgcactttgatttcctggaccctccaccatatgagacactgctgctggctttggagcagctgtatgctctgggagccctcaaccaccttggggagctcaccacgtctggtcgaaagatggcagagctgccggtggaccccatgctgtccaaaatgatcttagcctctgagaagtacagctgttcagaggagatcctgacagtggctgccatgctctctgtcaacaactccatcttctaccgaccaaaggacaaggtcgtccatgctgacaatgcccgtgtcaacttctttctccctggcggtgaccacctggttctgctaaatgtttacacacagtgggctgagagtggttactcttcccagtggtgctatgagaactttgtacagttcagatcgatgcgccgagcccgggatgtgcgggaacagctggaagggctcttggaacgtgtggaagttggtctcagttcctgccagggggactatatccgtgtacgcaaggccatcactgctggttacttttaccacacggcacggttgactcggagtggctaccgcacagtgaaacagcagcagacagtcttcattcatcccaactcctccctctttgagcaacagccacgctggctgctctaccacgaacttgtcttgaccaccaaagagttcatgagacaggtactggagattgagagcagttggcttctggaggtggctccccattattataaggccaaggagctagaagatccccatgctaagaaaatgcccaaaaaaataggcaaaacacgagaagagctagggtaagagaaggacgtaaacagaacctgacaccagctccttttccttctatacattatttaatacctattaaataaaattatttttggaataaa

SEQ ID NO: 361165 - DNA, 755 bp, Homo sapiens
aaaagggattcatgaatgtaatgggggtggggtcaggccagctgaacaatatgtgcctttttgactcttcagaggctgtgaatttctggtcttggaagatcacagtggagcaattggacagataggattttatccttcatatcccttgcaaaagatctctaagaacccatggagagccagccagcgcaagagtgtctgatgcagatgtttttgcccatcgagccagcctgctttgtggaatggctggggacttcaccatcacagttagggttaggcacaaagagttgaggtcagggaggtgggtaggggaagatggggatgagttcctgggacttggctgccacccagaaaagccaaagaacaaagagaaagaaggtgtcatgcacataactgagttaggaggaaaccaaggagcatgcagagtcctgtgagagttgaggtagaaaggcttaacttgctcctgtctccaaaagaagaaacagtcaagaatgatgccagcagcagttgtcccacaggacaccaggagcttctaggctatttgaatcacagcagctcaggtctattacccccagtcagccttgctggcccacccttattgaaagggaccctgccttccactttttttttcctttaaaacgtatcagccgggcgcggtggctcacgcctgtaatcccagcactttgggaggcagaggcaggcggatcacgaggtaaggagatcaagaccatcctggctaacacggtgaaaccccgtct

SEQ ID NO: 361166 - DNA, 5733 bp, Homo sapiens
ttttatacaaaacagtagcaatgtagaatatgggaatcgtcttccgctgccacgcacgcaagttgtgaacattccaagccaatgtatacaatttggaggggaaggctaaacaatagcatcaaccacgctactgaacataggaatttttcatttaaaaagattaaaaattagatagcaatgtcttcttaatattgctctcgtcattgaagactgaggaaaaataaaaagtgactttataagttttttaaaaaaagaggcaatggggaaaaaaacaagaggctgctacaacactgccatacagtcaaaccatcatacttcaatatttgcatactcgatagcagcattatttttactgaaccgtgtgcaactacatgtagaaacacatcaaagcaaaatatcatggcagttatcaatcaagatccaaaaaggaaaaaaacaaacaaaaaaataactctaggatgaacacactataagaacatttatggagaaagaatcagtatctacattcttggactgttccattctgccccaataaaagtgtcaattcaactgtcagctgtggatttttggcggatttgagtttttccagttcttatgatactgcatgcttggaacaaagggggtcataataaatccttctacacaatgaacttcataggcagacagctgaaaataaatttactacttgtaaacacacacaaaaaaaaaatacaagattttttgtatctttaaacaatcagtgcttccaaaagcccattatcttctatatcgacctctctcccctcggtctctgtctcgatcacataatcgctctctttctctttctctatcacgtcctctatctcgctctctgtctcgtctgttatctctagggcggtctcgctctcgttcccggtctctttcacggggtctacttctccggccactgacaacagcttgtgtgcgacgaaggaaatcatccaccctcatatcataatcatgtactcgtttatctctgtatcttgcttcatgtggtactggatgatgtcctgagtaagggggatgagcttgaggaggtggagcatggtgctgatagtaaggatggtgtggaggttgttccattcctgggtaagggggcattccttgccaaggtggtggtggtcccatgttatgaaattccctcacataatcattgtaggacccatttaaaaacacatctcggcgaactcctgaaaatcgtctgtccacttcctggtatcgtggatcctttaaataccctggtctctggtgaaactcagggggatagtcaatccttggtttctttctgctgttatgaatatcataatcttctggtcgacgccttcccacatcccggactggttctcgacgggatggacgtcctcgtgatcggggctgagaatgcattcttctcttgtgacgcattttatgaatgacctgatacaagtcaatactttcatcggggggaaacagaagacaaagctgggttccacattcaagttcaatttcctgtccatcacgtccgatctttactggtttatgttcattccaaggattggtgagatgagccgacttagtgaagggtaattcacgcctgcaaatccagtcaattttaaagacacctcccagcattttagcactcattcctgctggaagcacccagtgtataggagatcctccgtgatgtgattctgaagaaagtcttgcaaacccttgaaattttccactctctctgacagaaaatatcggacgcgtggggggatgtcggaagatcctagaggtcccaaggtagctgacttgcgaagctgaggctccagccgagggctccaggcctctgaccggcccagcagtgagcgcggctgcccgacgcttcagggccgggagcagggagcgtgagtcgccatggcgacgccggcgggtctggagcgctgggttcaggacgagctgcactcggtgttggggctgagcgagcggcacgtcgcccagtttctgatcggtaccgcacagcgctgcacctctgccgaggagttcgtgcagcgcctacgagacactgataccttggatctcagtgggccggcccgggacttcgccctgagactctggaacaaggtaccacgaaaggcagtggtagaaaagccagctcgggcagcagagcgagaggcccgggccctgctggagaagaaccgatcttataggttactggaagacagtgaagagagcagtgaggagactgtgagtagggctggaagcagcctccagaagaaacgtaaaaagcggaaacacctcaggaagaagcgtgaggaagaagaggaggaagaggcttctgagaaagggaagaagaaaacaggggggagtaaacagcagacagagaagccagagtcggaagatgagtgggaacggacagagcgtgaacgccttcaggacctggaggagcgtgatgcctttgctgagcgggttcgacagcgggacaaggatcggactcgaaatgtcctggaacggtcagacaagaaggcttatgaagaggctcagaagcgcctcaagatggccgaggaagaccggaaggccatggtccctgagctgcggaagaaatctcgccgagagtacctggctaagcgggagcgagagaagcttgaggacctggaggcggagctggctgatgaggagttcctttttggggacgtggagctgagccggcacgagcggcaggagctcaaatataagcggcgagtgcgggatctcgcccgggagtaccgggcagctggggagcaggagaagctggaggccaccaatcgctaccacatgcccaaggaaacccgaggacagccagcccgagctgtggatctagtggaggaggaatcaggagcccctggggaggagcagcggcgctgggaggaggcgcggcttggggcagcgtccctgaagtttggggcccgagatgctgcctctcaggagcccaagtatcaactggtgctggaggaggaggagaccattgagtttgtccgggccactcagctccagggtgatgaggagccgtcagctccacccacttcaactcaggcccagcagaaagagtccatccaggccgtccgccgcagcctcccggtgttcccatttcgagaggagctcctggctgctattgcaaatcaccaagtcctcatcattgaaggcgagacaggctcagggaagaccacccagatcccgcagtatctctttgaggagggttatacaaacaagggtatgaagattgcctgcacccaaccccggagagtggctgccatgagtgtggccgcccgagtggcccgggagatgggtgtgaagcttgggaatgaggttggctacagcatccgctttgaggactgcacatcagagcgaactgtcctccgctacatgacagatgggatgcttctccgggagttcctctctgagcctgacctggcgagttacagcgtggtgatggtggatgaggcacacgaaaggaccctacacacagacattctctttggattgatcaaggatgttgctcgcttccgacctgagctcaaggtcctggtggcttcagccacaatggacactgcccgtttttccaccttctttgatgacgcccctgtgtttcgaatccccggacgcaggtttcctgtggacatcttctacaccaaggctccagaggctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaaggtggttgtggcaacgaacattgctgagacatcactcaccattgagggcatcatttatgtgctggatccagggttctgtaagcagaagagctacaacccccgcacaggcatggaatcgctcactgtcacaccctgcagcaaggcctcagccaatcagcgagctggcagggcaggtcgggtggctgcagggaagtgcttccgcctgtataccgcctgggcctatcagcacgagcttgaggaaaccacagtgcctgagatccagaggaccagcttgggcaatgtcgtgttgctgctcaagagcttagggatccatgacctaatgcactttgatttcctggaccctccaccatatgagacactgctgctggctttggagcagctgtatgctctgggagccctcaaccaccttggggagctcaccacgtctggtcgaaagatggcagagctgccggtggaccccatgctgtccaaaatgatcttagcctctgagaagtacagctgttcagaggagatcctgacagtggctgccatgctctctgtcaacaactccatcttctaccgaccaaaggacaaggtcgtccatgctgacaatgcccgtgtcaacttctttctccctggcggtgaccacctggttctgctaaatgtttacacacagtgggctgagagtggttactcttcccagtggtgctatgagaactttgtacagttcagatcgatgcgccgagcccgggatgtgcgggaacagctggaagggctcttggaacgtgtggaagttggtctcagttcctgccagggggactatatccgtgtacgcaaggccatcactgctggttacttttaccacacggcacggttgactcggagtggctaccgcacagtgaaacagcagcagacagtcttcattcatcccaactcctccctctttgagcaacagccacgctggctgctctaccacgaacttgtcttgaccaccaaagagttcatgagacaggtactggagattgagagcagttggcttctggaggtggctccccattattataaggccaaggagctagaagatccccatgctaagaaaatgcccaaaaaaataggcaaaacacgagaagagctagggtaagagaaggacgtaaacagaacctgacaccagctccttttccttctatacattatttaatacctattaaataaaattatttttggaataaagcttgtgggaacatttgggatctagaaaaagtgatatgtgaaattctatctcatatagtcagttaaactttattatttacaagttaaattacacagcagctttacacagcatgagatggaaaggaaggaaggagagaaacgaggagaggaagctggctcctgagattcttggctgcctccacctccttctcttgggcgtagcagtcttcagtgctgcctccactccaaggtcaaggatcagggcttggaacacaggtttaagtcaggttctggctctgacagccccagggccaccagggctcccactagcagcttcttcacaggcgttggaggtgagtgtgaaggcatcagtttatctagacgatggcgacaaatgaggccactggaattcaggtagaaagtggagtaggcatcataggtccggtaatgctcgtctttgtcacgcttgtagaaccgcaaaaagagcaagtggacgggcagccccacaagccgccaccgggcttgcagggtccagttctcagggtggcgggtcagctgtaaaacctccaaacgaaggtgtgcaaaataattccaggccaggaaacggcagagggtcagtgaaagaatgtaccatgtccgg

SEQ ID NO: 361167 - DNA, 4437 bp, Homo sapiens
  misc_feature (4219)..(4219): n is a, c, g, or t
agaggccgaaaaagtacagccccttccgggctccgcggtacgggaagacagctttgggatgtcggaagatcctagaggtcccaaggtagctgacttgcgaagctgaggctccagccgagggctccaggcctctgaccggcccagcagtgagcgcggctgcccgacgcttcagggccgggagcagggagcgtgagtcgccatggcgacgccggcgggtctggagcgctgggttcaggacgagctgcactcggtgttggggctgagcgagcggcacgtcgcccagtttctgatcggtaccgcacagcgctgcacctctgccgaggagttcgtgcagcgcctacgagacactgataccttggatctcagtgggccggcccgggacttcgccctgagactctggaacaaggtaccacgaaaggcagtggtagaaaagccagctcgggcagcagagcgagaggcccgggccctgctggagaagaaccgatcttataggttactggaagacagtgaagagagcagtgaggagactgtgagtagggctggaagcagcctccagaagaaacgtaaaaagcggaaacacctcaggaagaagcgtgaggaagaagaggaggaagaggcttctgagaaagggaagaagaaaacaggggggagtaaacagcagacagagaagccagagtcggaagatgagtgggaacggacagagcgtgaacgccttcaggacctggaggagcgtgatgcctttgctgagcgggttcgacagcgggacaaggatcggactcgaaatgtcctggaacggtcagacaagaaggcttatgaagaggctcagaagcgcctcaagatggccgaggaagaccggaaggccatggtccctgagctgcggaagaaatctcgccgagagtacctggctaagcgggagcgagagaagcttgaggacctggaggcggagctggctgatgaggagttcctttttggggacgtggagctgagccggcacgagcggcaggagctcaaatataagcggcgagtgcgggatctcgcccgggagtaccgggcagctggggagcaggagaagctggaggccaccaatcgctaccacatgcccaaggaaacccgaggacagccagcccgagctgtggatctagtggaggaggaatcaggagcccctggggaggagcagcggcgctgggaggaggcgcggcttggggcagcgtccctgaagtttggggcccgagatgctgcctctcaggagcccaagtatcaactggtgctggaggaggaggagaccattgagtttgtccgggccactcagctccagggtgatgaggagccgtcagctccacccacttcaactcaggcccagcagaaagagtccatccaggccgtccgccgcagcctcccggtgttcccatttcgagaggagctcctggctgctattgcaaatcaccaagtcctcatcattgaaggcgagacaggctcagggaagaccacccagatcccgcagtatctctttgaggagggttatacaaacaagggtatgaagattgcctgcacccaaccccggagagtggctgccatgagtgtggccgcccgagtggcccgggagatgggtgtgaagcttgggaatgaggttggctacagcatccgctttgaggactgcacatcagagcgaactgtcctccgctacatgacagatgggatgcttctccgggagttcctctctgagcctgacctggcgagttacagcgtggtgatggtggatgaggcacacgaaaggaccctacacacagacattctctttggattgatcaaggatgttgctcgcttccgacctgagctcaaggtcctggtggcttcagccacaatggacactgcccgtttttccaccttctttgatgacgcccctgtgtttcgaatccccggacgcaggtttcctgtggacatcttctacaccaaggctccagaggctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaaggtggttgtggcaacgaacattgctgagacatcactcaccattgagggcatcatttatgtgctggatccagggttctgtaagcagaagagctacaacccccgcacaggcatggaatcgctcactgtcacaccctgcagcaaggcctcagccaatcagcgagctggcagggcaggtcgggtggctgcagggaagtgcttccgcctgtataccgcctgggcctatcagcacgagcttgaggaaaccacagtgcctgagatccagaggaccagcttgggcaatgtcgtgttgctgctcaagagcttagggatccatgacctaatgcactttgatttcctggaccctccaccatatgagacactgctgctggctttggagcagctgtatgctctgggagccctcaaccaccttggggagctcaccacgtctggtcgaaagatggcagagctgccggtggaccccatgctgtccaaaatgatcttagcctctgagaagtacagctgttcagaggagatcctgacagtggctgccatgctctctgtcaacaactccatcttctaccgaccaaaggacaaggtcgtccatgctgacaatgcccgtgtcaacttctttctccctggcggtgaccacctggttctgctaaatgtttacacacagtgggctgagagtggttactcttcccagtggtgctatgagaactttgtacagttcagatcgatgcgccgagcccgggatgtgcgggaacagctggaagggctcttggaacgtgtggaagttggtctcagttcctgccagggggactatatccgtgtacgcaaggccatcactgctggttacttttaccacacggcacggttgactcggagtggctaccgcacagtgaaacagcagcagacagtcttcattcatcccaactcctccctctttgagcaacagccacgctggctgctctaccacgaacttgtcttgaccaccaaagagttcatgagacaggtactggagattgagagcagttggcttctggaggtggctccccattattataaggccaaggagctagaagatccccatgctaagaaaatgcccaaaaaaataggcaaaacacgagaagagctagggtaagagaaggacgtaaacagaacctgacaccagctccttttccttctatacattatttaatacctattaaataaaattatttttggaataaaaaaaaaaacaaaaaaaaaaaaaaaaaaaacaacaacaaacacaaaaaaaaaaaaaaaaaaaaaaaaacaaagaagcaaagaaaaaccaaaacaaaacacaacacagcaagaacaaacaatcaccatcacacacacacacctccttaaccaacgccactcaccacctcacacacaagacacacacaaacaagacccgacgcacccacaaacctcagaagacgacatggcataggcacgaacactgcagagatggagagagtcgttgcgtatacacagagccgacactagcctcacatctagagcgaacatcatgactcatgctcagaagcacaaacagctcgctacgttataggctatgctgtatggtcgttaaagtaagcaagagcatgaacatctagctacgtcagtataaccatacacagagagcatcgcgagcccgctagcaacagacgagacatctacatttacgtccgaacgggtaatatgtgacaagcacgactatccaacacacggtcgtgtcggtctagtcataatgcgatttgccactagcgataagcgagctgaggcgaagggacagaccgtgaaggaggaagacgaaggctgcgcgcgcgacgcgaagaagagatgggacgactgagagatgccgagcgatgaagctgcgcagagaggacgctgaaggagcagatggccgaagagacgacgaacgagacaacgaggtgagtagagcgtcgagatgagcgagtgatgacatggtcacgcgtgaacgaagacgcggagacgagagaccgctgatgaccggagaggnacgtgggatcgaggagagtggtggatgaatctgactgcgacacggcgggcagggagtcatcgcgcgaggcgtaacgcgagcgcggacagcgaggaggcggagcgagctgcgaagcacggcgagcgatagacgtgacggagcgcgagactgaatgcgttggagtctaagagcgcgcagcgagactacgaaacaggggtctgcgacgagatgctacgcgg

SEQ ID NO: 361168 - DNA, 2619 bp, Homo sapiens
gtagggattggtagagaaaggggttgctcctccagcaagatgaggattcgactgtcctttcccaactcaggtccctgagctgcggaagaaatctcgccgagagtacctggctaagcgggagcgagagaagcttgaggacctggaggcggagctggctgatgaggagttcctttttggggacgtggagctgagccggcacgagcggcaggagctcaaatataagcggcgagtgcgggatctcgcccgggagtaccgggcagctggggagcaggagaagctggaggccaccaatcgctaccacatgcccaaggaaacccgaggacagccagcccgagctgtggatctagtggaggaggaatcaggagcccctggggaggagcagcggcgctgggaggaggcgcggcttggggcagcgtccctgaagtttggggcccgagatgctgcctctcaggagcccaagtatcaactggtgctggaggaggaggagaccattgagtttgtccgggccactcagctccagggtgatgaggagccgtcagctccacccacttcaactcaggcccagcagaaagagtccatccaggccgtccgccgcagcctcccggtgttcccatttcgagaggagctcctggctgctattgcaaatcaccaagtcctcatcattgaaggcgagacaggctcagggaagaccacccagatcccgcagtatctctttgaggagggttatacaaacaagggtatgaagattgcctgcacccaaccccggagagtggctgccatgagtgtggccgcccgagtggcccgggagatgggtgtgaagcttgggaatgaggttggctacagcatccgctttgaggactgcacatcagagcgaactgtcctccgctacatgacagatgggatgcttctccgggagttcctctctgagcctgacctggcgagttacagcgtggtgatggtggatgaggcacacgaaaggaccctacacacagacattctctttggattgatcaaggatgttgctcgcttccgacctgagctcaaggtcctggtggcttcagccacaatggacactgcccgtttttccaccttctttgatgacgcccctgtgtttcgaatccccggacgcaggtttcctgtggacatcttctacaccaaggctccagaggctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaaggtggttgtggcaacgaacattgctgagacatcactcaccattgagggcatcatttatgtgctggatccagggttctgtaagcagaagagctacaacccccgcacaggcatggaatcgctcactgtcacaccctgcagcaaggcctcagccaatcagcgagctggcagggcaggtcgggtggctgcagggaagtgcttccgcctgtataccgcctgggcctatcagcacgagcttgaggaaaccacagtgcctgagatccagaggaccagcttgggcaatgtcgtgttgctgctcaagagcttagggatccatgacctaatgcactttgatttcctggaccctccaccatatgagacactgctgctggctttggagcagctgtatgctctgggagccctcaaccaccttggggagctcaccacgtctggtcgaaagatggcagagctgccggtggaccccatgctgtccaaaatgatcttagcctctgagaagtacagctgttcagaggagatcctgacagtggctgccatgctctctgtcaacaactccatcttctaccgaccaaaggacaaggtcgtccatgctgacaatgcccgtgtcaacttctttctccctggcggtgaccacctggttctgctaaatgtttacacacagtgggctgagagtggttactcttcccagtggtgctatgagaactttgtacagttcagatcgatgcgccgagcccgggatgtgcgggaacagctggaagggctcttggaacgtgtggaagttggtctcagttcctgccagggggactatatccgtgtacgcaaggccatcactgctggttacttttaccacacggcacggttgactcggagtggctaccgcacagtgaaacagcagcagacagtcttcattcatcccaactcctccctctttgagcaacagccacgctggctgctctaccacgaacttgtcttgaccaccaaagagttcatgagacaggtactggagattgagagcagttggcttctggaggtggctccccattattataaggccaaggagctagaagatccccatgctaagaaaatgcccaaaaaaataggcaaaacacgagaagagctagggtaagagaaggacgtaaacagaacctgacaccagctccttttccttctatacattatttaatacctattaaataaaattatttttggaataaa

SEQ ID NO: 361169 - DNA, 1248 bp, Homo sapiens
agaggccgaaaaagtacagccccttccgggctccgcggtacgggaagacagctttgggatgtcggaagatcctagaggtcccaaggtagctgacttgcgaagctgaggctccagccgagggctccaggcctctgaccggcccagcagtgagcgcggctgcccgacgcttcagggccgggagcagggagcgtgagtcgccatggcgacgccggcgggtctggagcgctgggttcaggacgagctgcactcggtgttggggctgagcgagcggcacgtcgcccagtttctgatcggtaccgcacagcgctgcacctctgccgaggagttcgtgcagcgcctacgagacactgataccttggatctcagtgggccggcccgggacttcgccctgagactctggaacaaggtaccacgaaaggcagtggtagaaaagccagctcgggcagcagagcgagaggcccgggccctgctggagaagaaccgatcttataggttactggaagacagtgaagagagcagtgaggagactgtgagtagggctggaagcagcctccagaagaaacgtaaaaagcggaaacacctcaggaagaagcgtgaggaagaagaggaggaagaggcttctgagaaagggaagaagaaaacaggggggagtaaacagcagacagagaagccagagtcggaagatgagtgggaacggacagagcgtgaacgccttcaggacctggaggagcgtgatgcctttgctgagcgggttcgacagcgggacaaggatcggactcgaaatgtcctggaacggtcagacaagaaggcttatgaagaggctcagaagcgcctcaagatggccgaggaagaccggaaggccatgaccatttaaaagagtcttagacatcatggcgttttatctctaagtacatcagtgtgtacctgctaaggataaagatattgtcctctaaaatcagaatgctcttgtcacagtcaggaagttgaacagtaattcttatgtatcgactaagatctctctacaataaaagataccctcattaccctcaaaataactttaatgactgctttttcctaacaagaatgcagtcaaggttcatgcattgcatttgggtcttagatgttaagtttgtttctctctctgtctgtctcaccttgcagtgtcctacattctggatttgcctgattcttatcttgtggtgttaagtacttctctgccctgtgctttctttgaagcaggaattgggt

SEQ ID NO: 361170 - DNA, 1940 bp, Homo sapiens
aaaagggattcatgaatgtaatgggggtggggtcaggccagctgaacaatatgtgcctttttgactcttcagaggctgtgaatttctggtcttggaagatcacagtggagcaattggacagataggattttatccttcatatcccttgcaaaagatctctaagaacccatggagagccagccagcgcaagagtgtctgatgcagatgtttttgcccatcgagccagcctgctttgtggaatggctggggacttcaccatcacagttaggcgtggtgatggtggatgaggcacacgaaaggaccctacacacagacattctctttggattgatcaaggatgttgctcgcttccgacctgagctcaaggtcctggtggcttcagccacaatggacactgcccgtttttccaccttctttgatgacgcccctgtgtttcgaatccccggacgcaggtttcctgtggacatcttctacaccaaggctccagaggctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaaggtggttgtggcaacgaacattgctgagacatcactcaccattgagggcatcatttatgtgctggatccagggttctgtaagcagaagagctacaacccccgcacaggcatggaatcgctcactgtcacaccctgcagcaaggcctcagccaatcagcgagctggcagggcaggtcgggtggctgcagggaagtgcttccgcctgtataccgcctgggcctatcagcacgagcttgaggaaaccacagtgcctgagatccagaggaccagcttgggcaatgtcgtgttgctgctcaagagcttagggatccatgacctaatgcactttgatttcctggaccctccaccatatgagacactgctgctggctttggagcagctgtatgctctgggagccctcaaccaccttggggagctcaccacgtctggtcgaaagatggcagagctgccggtggaccccatgctgtccaaaatgatcttagcctctgagaagtacagctgttcagaggagatcctgacagtggctgccatgctctctgtcaacaactccatcttctaccgaccaaaggacaaggtcgtccatgctgacaatgcccgtgtcaacttctttctccctggcggtgaccacctggttctgctaaatgtttacacacagtgggctgagagtggttactcttcccagtggtgctatgagaactttgtacagttcagatcgatgcgccgagcccgggatgtgcgggaacagctggaagggctcttggaacgtgtggaagttggtctcagttcctgccagggggactatatccgtgtacgcaaggccatcactgctggttacttttaccacacggcacggttgactcggagtggctaccgcacagtgaaacagcagcagacagtcttcattcatcccaactcctccctctttgagcaacagccacgctggctgctctaccacgaacttgtcttgaccaccaaagagttcatgagacaggtactggagattgagagcagttggcttctggaggtggctccccattattataaggccaaggagctagaagatccccatgctaagaaaatgcccaaaaaaataggcaaaacacgagaagagctagggtaagagaaggacgtaaacagaacctgacaccagctccttttccttctatacattatttaatacctattaaataaaattatttttggaataaa

SEQ ID NO: 361171 - DNA, 5817 bp, Homo sapiens
ttttatacaaaacagtagcaatgtagaatatgggaatcgtcttccgctgccacgcacgcaagttgtgaacattccaagccaatgtatacaatttggaggggaaggctaaacaatagcatcaaccacgctactgaacataggaatttttcatttaaaaagattaaaaattagatagcaatgtcttcttaatattgctctcgtcattgaagactgaggaaaaataaaaagtgactttataagttttttaaaaaaagaggcaatggggaaaaaaacaagaggctgctacaacactgccatacagtcaaaccatcatacttcaatatttgcatactcgatagcagcattatttttactgaaccgtgtgcaactacatgtagaaacacatcaaagcaaaatatcatggcagttatcaatcaagatccaaaaaggaaaaaaacaaacaaaaaaataactctaggatgaacacactataagaacatttatggagaaagaatcagtatctacattcttggactgttccattctgccccaataaaagtgtcaattcaactgtcagctgtggatttttggcggatttgagtttttccagttcttatgatactgcatgcttggaacaaagggggtcataataaatccttctacacaatgaacttcataggcagacagctgaaaataaatttactacttgtaaacacacacaaaaaaaaaatacaagattttttgtatctttaaacaatcagtgcttccaaaagcccattatcttctatatcgacctctctcccctcggtctctgtctcgatcacataatcgctctctttctctttctctatcacgtcctctatctcgctctctgtctcgtctgttatctctagggcggtctcgctctcgttcccggtctctttcacggggtctacttctccggccactgacaacagcttgtgtgcgacgaaggaaatcatccaccctcatatcataatcatgtactcgtttatctctgtatcttgcttcatgtggtactggatgatgtcctgagtaagggggatgagcttgaggaggtggagcatggtgctgatagtaaggatggtgtggaggttgttccattcctgggtaagggggcattccttgccaaggtggtggtggtcccatgttatgaaattccctcacataatcattgtaggacccatttaaaaacacatctcggcgaactcctgaaaatcgtctgtccacttcctggtatcgtggatcctttaaataccctggtctctggtgaaactcagggggatagtcaatccttggtttctttctgctgttatgaatatcataatcttctggtcgacgccttcccacatcccggactggttctcgacgggatggacgtcctcgtgatcggggctgagaatgcattcttctcttgtgacgcattttatgaatgacctgatacaagtcaatactttcatcggggggaaacagaagacaaagctgggttccacattcaagttcaatttcctgtccatcacgtccgatctttactggtttatgttcattccaaggattggtgagatgagccgacttagtgaagggtaattcacgcctgcaaatccagtcaattttaaagacacctcccagcattttagcactcattcctgctggaagcacccagtgtataggagatcctccgtgatgtgattctgaagaaagtcttgcaaacccttgaaattttccactctctctgacagaaaatatcggacgcgtggggggatgtcggaagatcctagaggtcccaaggtagctgacttgcgaagctgaggctccagccgagggctccaggcctctgaccggcccagcagtgagcgcggctgcccgacgcttcagggccgggagcagggagcgtgagtcgccatggcgacgccggcgggtctggagcgctgggttcaggacgagctgcactcggtgttggggctgagcgagcggcacgtcgcccagtttctgatcggtaccgcacagcgctgcacctctgccgaggagttcgtgcagcgcctacgagacactgataccttggatctcagtgggccggcccgggacttcgccctgagactctggaacaaggtaccacgaaaggcagtggtagaaaagccagctcgggcagcagagcgagaggcccgggccctgctggagaagaaccgatcttataggttactggaagacagtgaagagagcagtgaggagactgtgagtagggctggaagcagcctccagaagaaacgtaaaaagcggaaacacctcaggaagaagcgtgaggaagaagaggaggaagaggcttctgagaaagggaagaagaaaacaggggggagtaaacagcagacagagaagccagagtcggaagatgagtgggaacggacagagcgtgaacgccttcaggacctggaggagcgtgatgcctttgctgagcgggttcgacagcgggacaaggatcggactcgaaatgtcctggaacggtcagacaagaaggcttatgaagaggctcagaagcgcctcaagatggccgaggaagaccggaaggccatggtccctgagctgcggaagaaatctcgccgagagtacctggctaagcgggagcgagagaagcttgaggacctggaggcggagctggctgatgaggagttcctttttggggacgtggagctgagccggcacgagcggcaggagctcaaatataagcggcgagtgcgggatctcgcccgggagtaccgggcagctggggagcaggagaagctggaggccaccaatcgctaccacatgcccaaggaaacccgaggacagccagcccgagctgtggatctagtggaggaggaatcaggagcccctggggaggagcagcggcgctgggaggaggcgcggcttggggcagcgtccctgaagtttggggcccgagatgctgcctctcaggagcccaagtatcaactggtgctggaggaggaggagaccattgagtttgtccgggccactcagctccagggtgatgaggagccgtcagctccacccacttcaactcaggcccagcagaaagagtccatccaggccgtccgccgcagcctcccggtgttcccatttcgagaggagctcctggctgctattgcaaatcaccaagtcctcatcattgaaggcgagacaggctcagggaagaccacccagatcccgcagtatctctttgaggagggttatacaaacaagggtatgaagattgcctgcacccaaccccggagagtggctgccatgagtgtggccgcccgagtggcccgggagatgggtgtgaagcttgggaatgaggttggctacagcatccgctttgaggactgcacatcagagcgaactgtcctccgctacatgacagatgggatgcttctccgggagttcctctctgagcctgacctggcgagttacagcgtggtgatggtggatgaggcacacgaaaggaccctacacacagacattctctttggattgatcaaggatgttgctcgcttccgacctgagctcaaggtcctggtggcttcagccacaatggacactgcccgtttttccaccttctttgatgacgcccctgtgtttcgaatccccggacgcaggtttcctgtggacatcttctacaccaaggctccagaggctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaaggtggttgtggcaacgaacattgctgagacatcactcaccattgagggcatcatttatgtgctggatccagggttctgtaagcagaagagctacaacccccgcacaggcatggaatcgctcactgtcacaccctgcagcaaggcctcagccaatcagcgagctggcagggcaggtcgggtggctgcagggaagtgcttccgcctgtataccgcctgggcctatcagcacgagcttgaggaaaccacagtgcctgagatccagaggaccagcttgggcaatgtcgtgttgctgctcaagagcttagggatccatgacctaatgcactttgatttcctggaccctccaccatatgagacactgctgctggctttggagcagctgtatgctctgggagccctcaaccaccttggggagctcaccacgtctggtcgaaagatggcagagctgccggtggaccccatgctgtccaaaatgatcttagcctctgagaagtacagctgttcagaggagatcctgacagtggctgccatgctctctgtcaacaactccatcttctaccgaccaaaggacaaggtcgtccatgctgacaatgcccgtgtcaacttctttctccctggcggtgaccacctggttctgctaaatgtttacacacagtgggctgagagtggttactcttcccagtggtgctatgagaactttgtacagttcagatcgatgcgccgagcccgggatgtgcgggaacagctggaagggctcttggaacgtgtggaagttggtctcagttcctgccagggggactatatccgtgtacgcaaggccatcactgctggttacttttaccacacggcacggttgactcggagtggctaccgcacagtgaaacagcagcagacagtcttcattcatcccaactcctccctctttgagcaacagccacgctggctgctctaccacgaacttgtcttgaccaccaaagagttcatgagacaggtactggagattgagagcagttggcttctggaggtggctccccattattataaggccaaggagctagaagatccccatgctaagaaaatgcccaaaaaaataggcaaaacacgagaagagctagggtaagagaaggacgtaaacagaacctgacaccagctccttttccttctatacattatttaatacctattaaataaaattatttttggaataaagcttgtgggaacatttgggatctagaaaaagtgatatgtgaaattctatctcatatagtcagttaaactttattatttacaagttaaattacacagcagctttacacagcatgagatggaaaggaaggaaggagagaaacgaggagaggaagctggctcctgagattcttggctgcctccacctccttctcttgggcgtagcagtcttcagtgctgcctccactccaaggtcaaggatcagggcttggaacacaggtttaagtcaggttctggctctgacagccccagggccaccagggctcccactagcagcttcttcacaggcgttggaggtgagtgtgaaggcatcagctgcagggagaaaggttaatgccagttgggggaggcacacaaatgttctaccctttaccccacccagccctacctaggactcactttatctagacgatggcgacaaatgaggccactggaattcaggtagaaagtggagtaggcatcataggtccggtaatgctcgtctttgtcacgcttgtagaaccgcaaaaagagcaagtggacgggcagccccacaagccgccaccgggcttgcagggtccagttctcagggtggcgggtcagctgtaaaacctccaaacgaaggtgtgcaaaataattccaggccaggaaacggcagagggtcagtgaaagaatgtaccatgtccgg

SEQ ID NO: 361172 - DNA, 1913 bp, Homo sapiens
agaggccgaaaaagtacagccccttccgggctccgcggtacgggaagacagctttgggatgtcggaagatcctagaggtcccaaggtagctgacttgcgaagctgaggctccagccgagggctccaggcctctgaccggcccagcagtgagcgcggctgcccgacgcttcagggccgggagcagggagcgtgagtcgccatggcgacgccggcgggtctggagcgctgggttcaggacgagctgcactcggtgttggggctgagcgagcggcacgtcgcccagtttctgatcggtaccgcacagcgctgcacctctgccgaggagttcgtgcagcgcctacgagacactgataccttggatctcagtgggccggcccgggacttcgccctgagactctggaacaaggtaccacgaaaggcagtggtagaaaagccagctcgggcagcagagcgagaggcccgggccctgctggagaagaaccgatcttataggttactggaagacagtgaagagagcagtgaggagactgtgagtagggctggaagcagcctccagaagaaacgtaaaaagcggaaacacctcaggaagaagcgtgaggaagaagaggaggaagaggcttctgagaaagggaagaagaaaacaggggggagtaaacagcagacagagaagccagagtcggaagatgagtgggaacggacagagcgtgaacgccttcaggacctggaggagcgtgatgcctttgctgagcgggttcgacagcgggacaaggatcggactcgaaatgtcctggaacggtcagacaagaaggcttatgaagaggctcagaagcgcctcaagatggccgaggaagaccggaaggccatggtccctgagctgcggaagaaatctcgccgagagtacctggctaagcgggagcgagagaagcttgaggacctggaggcggagctggctgatgaggagttcctttttggggacgtggagctgagccggcacgagcggcaggagctcaaatataagcggcgagtgcgggatctcgcccgggagtaccgggcagctggggagcaggagaagctggaggccaccaatcgctaccacatgcccaaggaaacccgaggacagccagcccgagctgtggatctagtggaggaggaatcaggagcccctggggaggagcagcggcgctgggaggaggcgcggcttggggcagcgtccctgaagtttggggcccgagatgctgcctctcaggagcccaagtatcaactggtgctggaggaggaggagaccattgagtttgtccgggccactcagctccagggtgatgaggagccgtcagctccacccacttcaactcaggcccagcagaaagagtccatccaggccgtccgccgcagcctcccggtgttcccatttcgagaggagctcctggctgctattgcaaatcaccaagtcctcatcattgaaggcgagacaggctcagggaagaccacccagatcccgcagtatctctttgaggagggttatacaaacaagggtatgaagattgcctgcacccaaccccggagagtggctgccatgagtgtggccgcccgagtggcccgggagatgggtgtgaagcttgggaatgaggttggctacagcatccgctttgaggactgcacatcagagcgaactgtcctccgctacatgacagatgggatgcttctccgggagttcctctctgagcctgacctggcgagttacagcgtggtgatggtggatgaggcacacgaaaggaccctacacacagacattctctttggattgatcaaggatgttgctcgcttccgacctgagctcaaggggtttgtgaagccaccaggtcgagccgccgcgaatttagtagtagtagtagttgttattatccgccgcccgc

SEQ ID NO: 361173 - DNA, 684 bp, Homo sapiens
aataaagcttgtgggaacatttgggatctagaaaaagtgatatgtgaaattctatctcatatagtcagttaaactttattatttacaagttaaattacacagcagctttacacagcatgagatggaaaggaaggaaggagagaaacgaggagaggaagctggctcctgagattcttggctgcctccacctccttctcttgggcgtagcagtcttcagtgctgcctccactccaaggtcaaggatcagggcttggaacacaggtttaagtcaggttctggctctgacagccccagggccaccagggctcccactagcagcttcttcacaggcgttggaggtgagtgtgaaggcatcagctgcagggagaaaggttaatgccagttgggggaggcacacaaatgttctaccctttaccccacccagccctacctaggactcactttatctagacgatggcgacaaatgaggccactggaattcaggtagaaagtggagtaggcatcataggtcctggggaatagagggaggcttactgagggagaaggtgactggtcccaaagctgaattcaagcatttgtttaaacgagtagtccctaaattctgctacatattagatcacctgggcaacttacaaacatctcagtgcttaggttgtgccctgtctcaattaaatcagagtgttt

SEQ ID NO: 361174 - DNA, 541 bp, Homo sapiens
cagttcatacgtatttataattgttacatcttcttgtgatttgactctcttaccaacatacgatgtctttctgtaacattttttggcttaaaatctattttgtctggtattagtatagccaccccagctctcttttggttactatttgcatggattatctctttccgtcttttcattttgaaacaatttgtgtcttgggtctacagtgagtattttgtaagttgcatatttggattgtgtattacatcatttaaaaaaaatccattctgccgatctttccattggtcagattatttacatttaaagtgattactgaaacaaaaaagttaattgaccggcatggtggctcccgcctggaggtgaggctgcagtgagccatgatcgcaccactgctcttcagcctgggggacagagagattgactcaaaaacaaaaaacaaaaacttacttatggttggactcaggcctgtaatcctatcactttgggatgctgaggtgggcagattgcttgagcccaggcgtttgagaccagtctgggcaac

SEQ ID NO: 361175 - DNA, 481 bp, Homo sapiens
atcacaatgggttggggctccctggaagcccctgtgaaatgcccactgagctggggaaggcctgggctgacctatgagctgttttattgtcttccttcctactgcacgttgtggctcagtaagtatatacgtggaaagatctgcctgaacttggctgaccccagggcctcggcagaagagaggattgccccttggccccaaggccttagccctgaggtcacaggacgggggctacgagacagaggtggccctagtgatttctagttttgggtttgtagccgtgaacattttccacactctgcagcttctttcagtttctttctgacagcctgggaaaggaactgtcagacttagagatctgctatgaaagggctagagagaaaattctaaggaaccagaagtggtttttcaattttgaaataaaaatgtcaactaataagagtgagaactcatatatccccaaggaagggcagtaatgtag

SEQ ID NO: 361176 - DNA, 1444 bp, Homo sapiens
cacggggcgggcggacgctggcgcgggtaggtaagagcagcggcgggcggtggcgctcactcccggcttccaaccgcgcggagcctctgccttggagattctcagtgctgcggatcatgtccctaaggggcagcctctcgcgtctcctccagacgcgagtgcattccatcctgaagaaatccgtccactccgtggctgtgataggagccccgttctcacaagggcagaaaagaaaaggagtggagcatggtcccgctgccataagagaagctggcttgatgaaaaggctctccagtttgggctgccacctaaaagactttggagatttgagttttactccagtccccaaagatgatctctacaacaacctgatagtgaatccacgctcagtgggtcttgccaaccaggaactggctgaggtggttagcagagctgtgtcagatggctacagctgtgtcacactgggaggagaccacagcctggcaatcggtaccattagtggccatgcccgacactgcccagacctttgtgttgtctgggttgatgcccatgctgacatcaacacaccccttaccacttcatcaggaaatctccatggacagccagtttcatttctcctcagagaactacaggataaggtaccacaactcccaggattttcctggatcaaaccttgtatctcttctgcaagtattgtgtatattggtctgagagacgtggaccctcctgaacattttattttaaagaactatgatatccagtatttttccatgagagatattgatcgacttggtatccagaaggtcatggaacgaacatttgatctgctgattggcaagagacaaagaccaatccatttgagttttgatattgatgcatttgaccctacactggctccagccacaggaactcctgttgtcgggggactaacctatcgagaaggcatgtatattgctgaggaaatacacaatacagggttgctatcagcactggatcttgttgaagtcaatcctcagttggccacctcagaggaagaggcgaagactacagctaacctggcagtagatgtgattgcttcaagctttggtcagacaagagaaggagggcatattgtctatgaccaacttcctactcccagttcaccagatgaatcagaaaatcaagcacgtgtgagaatttaggagacactgtgcactgacatgtttcacaacaggcattccagaattatgaggcattgaggggatagatgaatactaaatggttgtctgggtcaatactgccttaatgagaacatttacacattctcacaattgtaaagtttcccctctattttggtgaccaatactactgtaaatgtatttggttttttgcagttcacagggtattaatatgctacagtactatgtaaatttaaagaagtcataaacagcatttattaccttgg

SEQ ID NO: 361177 - DNA, 1988 bp, Homo sapiens
cacggggcgggcggacgctggcgcgggtaggtaagagcagcggcgggcggtggcgctcactcccggcttccaaccgcgcggagcctctgccttggagattctcagtgctgcggatcatgtccctaaggggcagcctctcgcgtctcctccagacgcgagtgcattccatcctgaagaaatccgtccactccgtggctgtgataggagccccgttctcacaagggcagaaaagaaaaggagtggagcatggtcccgctgccataagagaagctggcttgatgaaaaggctctccagtttgggctgccacctaaaagactttggagatttgagttttactccagtccccaaagatgatctctacaacaacctgatagtgaatccacgctcagtgggtcttgccaaccaggaactggctgaggtggttagcagagctgtgtcagatggctacagctgtgtcacactgggaggagaccacagcctggcaatcggtaccattagtggccatgcccgacactgcccagacctttgtgttgtctgggttgatgcccatgctgacatcaacacaccccttaccacttcatcaggaaatctccatggacagccagtttcatttctcctcagagaactacaggataaggtaccacaactcccaggattttcctggatcaaaccttgtatctcttctgcaagtattgtgtatattggtctgagagacgtggaccctcctgaacattttattttaaagaactatgatatccagtatttttccatgagagatattgatcgacttggtatccagaaggtcatggaacgaacatttgatctgctgattggcaagagacaaagaccaatccatttgagttttgatattgatgcatttgaccctacactggctccagccacaggaactcctgttgtcgggggactaacctatcgagaaggcatgtatattgctgaggaaatacacaatacagggttgctatcagcactggatcttgttgaagtcaatcctcagttggccacctcagaggaagaggcgaagactacagctaacctggcagtagatgtgattgcttcaagctttggtcagacaagagaaggagggcatattgtctatgaccaacttcctactcccagttcaccagatgaatcagaaaatcaagcacgtgtgagaatttaggagacactgtgcactgacatgtttcacaacaggcattccagaattatgaggcattgaggggatagatgaatactaaatggttgtctgggtcaatactgccttaatgagaacatttacacattctcacaattgtaaagtttcccctctattttggtgaccaatactactgtaaatgtatttggttttttgcagttcacagggtattaatatgctacagtactatgtaaatttaaagaagtcataaacagcatttattaccttggtatatcatactggtcttgttgctgttgttccttcacatttaagtggtttttcatctttcctccctcctcccacagcctggctatacagtgcatccttgaactgtcagcccacagcagcaatatgcttattctatccacatccctaacatcatgcattcacaaggtcaaagttctggtccacaaacccttccctatagaagttcaatggctgcgaaagaatttgtagtaaaccaggcctcccaggatggcgagctccagtaagatgataatggaaagcagcagcttgttggttgtcactctacaaagagaagcaaagtggggagtagtcagaagtttggataaccttccttctaaacattttggggttagacctgggaccacggctggatactctgaggctgtatgtttgatcacacagccacttagcaggaagtactcataaggttctttagctgtcacttagggataacactgtctacctcacagaaatgttaaactgagacaataaaaaccaaagcataaaaatggattctgaaatgttgtt

SEQ ID NO: 361178 - DNA, 3561 bp, Homo sapiens
cacggggcgggcggacgctggcgcgggtaggtaagagcagcggcgggcggtggcgctcactcccggcttccaaccgcgcggagcctctgccttggagattctcagtgctgcggatcatgtccctaaggggcagcctctcgcgtctcctccagacgcgagtgcattccatcctgaagaaatccgtccactccgtggctgtgataggagccccgttctcacaagggcagaaaagaaaaggagtggagcatggtcccgctgccataagagaagctggcttgatgaaaaggctctccagtttgggctgccacctaaaagactttggagatttgagttttactccagtccccaaagatgatctctacaacaacctgatagtgaatccacgctcagtgggtcttgccaaccaggaactggctgaggtggttagcagagctgtgtcagatggctacagctgtgtcacactgggaggagaccacagcctggcaatcggtaccattagtggccatgcccgacactgcccagacctttgtgttgtctgggttgatgcccatgctgacatcaacacaccccttaccacttcatcaggaaatctccatggacagccagtttcatttctcctcagagaactacaggataaggtaccacaactcccaggattttcctggatcaaaccttgtatctcttctgcaagtattgtgtatattggtctgagagacgtggaccctcctgaacagtaagttgatgcatttggctgaagtttagggcctgtcctagccaattatgttctatttgaaaggctgatgcttaacttggtctattgcaggtcactacaacaaacccaccctctcccccaaatacatatttgttaaaaatgctctttaaactaaggactcctccctttatatctcatcacagttttattttaaagaactatgatatccagtatttttccatgagagatattgatcgacttggtatccagaaggtcatggaacgaacatttgatctgctgattggcaagtaagtaactataactgatgtcagggcaaacccccaatgggcaacacacttttagcctgtttcttgaggacagcagctttacttttaaaatacaaagcaaaaacatacacataattttaaatagttcagaaaggcaaaatttgaaacacaggtcatattcttcctctggggtttttgggaggaggtttcctctaaatcattgcctagatcttctgtctcatgaatttttctttatctccatctttaatgcttatcttctgagatgacaagcatttattgtttcaactgtcccattcttcccagcctcacgattgtttcatctgagttttatattaagcaaatcttggcagtgtagaaagatggcagatgaatactaatcaaatggtaattttaagagcattttcccaataccaagtctttacttctgggtgattaatgtcagaattgttatctggtagtatgtcatttcataagctgttaagaaacttagttgttagcttcagcctttggacactggggctataatgaagttagaaatggaagatgttaaaactgcagacctaaaattagagttcacttcagctgctgttacgttcagagaataagagcaaccataacttacatcaagccaatttaaattagactaatttaaattgtctaattaaattgtctctagatgagagcccaatctcatctagaagtgaagaaatctctctattgacagttattagtataagaggttctaatacccagtgtaaggcagaaatatacattggagttagtctgtctgaggtatgcagaacaaatggcagtatcatgaagtggtatgtaggaagttaatattgccaatctcagtaacttccaagaataggaagcctggaaatgtattaacagctttattaacaaagtactaggactaatagcaacaaaatcaaggagttgcaaccataagaaggatgagtgtccaaggacaaccagttaagtattattttaagtattattttatcctcttcctttttaggagacaaagaccaatccatttgagttttgatattgatgcatttgaccctacactggctccagccacaggaactcctgttgtcgggggactaacctatcgagaaggcatgtatattgctgaggaaatacacaatacaggtatgtagcaaccaggtctgcagcctgttaactacataggtaaatatgctagagtctcttgcctgcaaaggatcttttctgctattccacatcattgcagagtttgtttttgcttaaacttttgtagctaaaaattatatggccatgctaataaaaaggatatagtcctttagagtcatgcttggacatggctcttaccaaattacactaaggtaataatgagtaaaaaattgtatatttaaacaattaaatacaagaataaattgtcaaactgatgcagttctttgagttatctaaaggcagattaagataagaaggcaagataagataagagtgcaaggctgtaatttgcactctaagagattggttcattgggagttgtgaatttggagctaaagctgatctcttgaagaaatctgcaaactggacaatatcttgggtcctttatgtagggtaggtcttgtactagagcctgaaaggatttctaataagggggatacagttagatgagaatggctgatggaaagagtactaagatgaattctacgttatcaagaccggctacttttccaaaactcatacttgtttgcaaacagtttccatttctgtcagaaagcttctggttttaaagctacttcaaatgacctttcattccaaaatttaaagaactaccaaatcatactgcttcagtaaccatctgatggaactagggtatagatagagaccccagattgaaaggttcagggctatagagaacccttgactagctgggatagaaactcacattgagaaatggtctccttagcgccacagcctgccagaaccttaggcagtacaaaaaggcaggcagtactggtctaattctcagatctgcaatcttagatgttgccagtggtccttaggttattggccagagaacttgggggttcaattctctgctttgcttcctaaaaacaccacttagagcaggggttaataacctctagcacttatatatggcatggcttgtctctttgttcctatgctacaatattttactccaaaagacactcatggggctaggcacagtggttcatacctataatcccagtactctgggaggccaaggcaagaggattacttgaccccaggggttcaagaccagcgtgggcaacatagtgtgaccccgtttctacaaaaaataattagccaggtgtcccaactacttgggaggttgaggctgcagtgagccatgattgtgccactgcactgttataatgctgtcaactagatacataaagcagtttgcttaatttatagggtggcaatagtctggaaacataagtcatgtatatatttctaatagtgcaaactttgatgaccacttctgggatatgctaaagg

SEQ ID NO: 361179 - DNA, 3253 bp, Homo sapiens
agaaccactcctatagatcagtaatgtgcaatgggatagaaagggctaatcagcagtattcctgctactaggtaagttaatgagaaaccaagacaaccttagagattttattcgtcttgagaaagcaatactgtgttcctcagctgcccttctgaaacatttccaccttgtgtcacttctccttcccagatcaagtgtgtcctgtgttgctctaaacttaccctgtgggtggcagaagaaagcagattgcatacccacggacgcacatgataatgatcttggtgagaacaagaattcttgattaatcctgtccatttctccctttcataggtaccacaactcccaggattttcctggatcaaaccttgtatctcttctgcaagtattgtgtatattggtctgagagacgtggaccctcctgaacagtaagttgatgcatttggctgaagtttagggcctgtcctagccaattatgttctatttgaaaggctgatgcttaacttggtctattgcaggtcactacaacaaacccaccctctcccccaaatacatatttgttaaaaatgctctttaaactaaggactcctccctttatatctcatcacagttttattttaaagaactatgatatccagtatttttccatgagagatattgatcgacttggtatccagaaggtcatggaacgaacatttgatctgctgattggcaagtaagtaactataactgatgtcagggcaaacccccaatgggcaacacacttttagcctgtttcttgaggacagcagctttacttttaaaatacaaagcaaaaacatacacataattttaaatagttcagaaaggcaaaatttgaaacacaggtcatattcttcctctggggtttttgggaggaggtttcctctaaatcattgcctagatcttctgtctcatgaatttttctttatctccatctttaatgcttatcttctgagatgacaagcatttattgtttcaactgtcccattcttcccagcctcacgattgtttcatctgagttttatattaagcaaatcttggcagtgtagaaagatggcagatgaatactaatcaaatggtaattttaagagcattttcccaataccaagtctttacttctgggtgattaatgtcagaattgttatctggtagtatgtcatttcataagctgttaagaaacttagttgttagcttcagcctttggacactggggctataatgaagttagaaatggaagatgttaaaactgcagacctaaaattagagttcacttcagctgctgttacgttcagagaataagagcaaccataacttacatcaagccaatttaaattagactaatttaaattgtctaattaaattgtctctagatgagagcccaatctcatctagaagtgaagaaatctctctattgacagttattagtataagaggttctaatacccagtgtaaggcagaaatatacattggagttagtctgtctgaggtatgcagaacaaatggcagtatcatgaagtggtatgtaggaagttaatattgccaatctcagtaacttccaagaataggaagcctggaaatgtattaacagctttattaacaaagtactaggactaatagcaacaaaatcaaggagttgcaaccataagaaggatgagtgtccaaggacaaccagttaagtattattttaagtattattttatcctcttcctttttaggagacaaagaccaatccatttgagttttgatattgatgcatttgaccctacactggctccagccacaggaactcctgttgtcgggggactaacctatcgagaaggcatgtatattgctgaggaaatacacaatacaggtatgtagcaaccaggtctgcagcctgttaactacataggtaaatatgctagagtctcttgcctgcaaaggatcttttctgctattccacatcattgcagagtttgtttttgcttaaacttttgtagctaaaaattatatggccatgctaataaaaaggatatagtcctttagagtcatgcttggacatggctcttaccaaattacactaaggtaataatgagtaaaaaattgtatatttaaacaattaaatacaagaataaattgtcaaactgatgcagttctttgagttatctaaaggcagattaagataagaaggcaagataagataagagtgcaaggctgtaatttgcactctaagagattggttcattgggagttgtgaatttggagctaaagctgatctcttgaagaaatctgcaaactggacaatatcttgggtcctttatgtagggtaggtcttgtactagagcctgaaaggatttctaataagggggatacagttagatgagaatggctgatggaaagagtactaagatgaattctacgttatcaagaccggctacttttccaaaactcatacttgtttgcaaacagtttccatttctgtcagaaagcttctggttttaaagctacttcaaatgacctttcattccaaaatttaaagaactaccaaatcatactgcttcagtaaccatctgatggaactagggtatagatagagaccccagattgaaaggttcagggctatagagaacccttgactagctgggatagaaactcacattgagaaatggtctccttagcgccacagcctgccagaaccttaggcagtacaaaaaggcaggcagtactggtctaattctcagatctgcaatcttagatgttgccagtggtccttaggttattggccagagaacttgggggttcaattctctgctttgcttcctaaaaacaccacttagagcaggggttaataacctctagcacttatatatggcatggcttgtctctttgttcctatgctacaatattttactccaaaagacactcatggggctaggcacagtggttcatacctataatcccagtactctgggaggccaaggcaagaggattacttgaccccaggggttcaagaccagcgtgggcaacatagtgtgaccccgtttctacaaaaaataattagccaggtgtcccaactacttgggaggttgaggctgcagtgagccatgattgtgccactgcactgttataatgctgtcaactagatacataaagcagtttgcttaatttatagggtggcaatagtctggaaacataagtcatgtatatatttctaatagtgcaaactttgatgaccacttctgggatatgctaaagg

SEQ ID NO: 361180 - DNA, 1193 bp, Homo sapiens
cacggggcgggcggacgctggcgcgggtaggtaagagcagcggcgggcggtggcgctcactcccggcttccaaccgcgcggagcctctgccttggagattctcagtgctgcggatcatgtccctaaggggcagcctctcgcgtctcctccagacgcgagtgcattccatcctgaagaaatccgtccactccgtggctgtgataggagccccgttctcacaagggcagaaaagaaaaggagtggagcatggtcccgctgccataagagaagctggcttgatgaaaaggctctccagtttgggctgccacctaaaagactttggagatttgagttttactccagtccccaaagatgatctctacaacaacctgatagtgaatccacgctcagtgggtcttgccaaccaggaactggctgaggtggttagcagagctgtgtcagatggctacagctgtgtcacactgggaggagaccacagcctggcaatcggtaccattagtggccatgcccgacactgcccagacctttgtgttgtctgggttgatgcccatgctgacatcaacacaccccttaccacttcatcaggaaatctccatggacagccagtttcatttctcctcagagaactacaggataaggtaccacaactcccaggattttcctggatcaaaccttgtatctcttctgcaagtattgtgtatattggtctgagagacgtggaccctcctgaacattttattttaaagaactatgatatccagtatttttccatgagagatattgatcgacttggtatccagaaggtcatggaacgaacatttgatctgctgattggcaagagacaaagaccaatccatttgagttttgatattgatgcatttgaccctacactggctccagccacaggaactcctgttgtcgggggactaacctatcgagaaggcatgtatattgctgaggaaatacacaatacagggttgctatcagcactggatcttgttgaagtcaatcctcagttggccacctcagaggaagaggcgaagactacagctaacctggcagtagatgtgattgcttcaagctttggtcagacagggagggatttggttttgacaacttctactccagtcacagatgatcaaatcagcctgtgaatttgggacggtgtgatgttcaagggttccttagggggg

SEQ ID NO: 361181 - DNA, 1959 bp, Homo sapiens
  misc_feature (1)..(1): n is a, c, g, or t
  misc_feature (80)..(80): n is a, c, g, or t
ngcgttcagagaataagagcaaccgcccccccttttaaaaaaaaaaaaattttttttttttaaaaaaaaaaaaaaaattntttggtcctcctagatgagagcccaatctcatctagaagtgaagaaatctctctattgacagttattagtataagaggttctaatacccagtgtaaggcagaaatatacattggagttagtctgtctgaggtatgcagaacaaatggcagtatcatgaagtggtatgtaggaagttaatattgccaatctcagtaacttccaagaataggaagcctggaaatgtattaacagctttattaacaaagtactaggactaatagcaacaaaatcaaggagttgcaaccataagaaggatgagtgtccaaggacaaccagttaagtattattttaagtattattttatcctcttcctttttaggagacaaagaccaatccatttgagttttgatattgatgcatttgaccctacactggctccagccacaggaactcctgttgtcgggggactaacctatcgagaaggcatgtatattgctgaggaaatacacaatacaggtatgtagcaaccaggtctgcagcctgttaactacataggtaaatatgctagagtctcttgcctgcaaaggatcttttctgctattccacatcattgcagagtttgtttttgcttaaacttttgtagctaaaaattatatggccatgctaataaaaaggatatagtcctttagagtcatgcttggacatggctcttaccaaattacactaaggtaataatgagtaaaaaattgtatatttaaacaattaaatacaagaataaattgtcaaactgatgcagttctttgagttatctaaaggcagattaagataagaaggcaagataagataagagtgcaaggctgtaatttgcactctaagagattggttcattgggagttgtgaatttggagctaaagctgatctcttgaagaaatctgcaaactggacaatatcttgggtcctttatgtagggtaggtcttgtactagagcctgaaaggatttctaataagggggatacagttagatgagaatggctgatggaaagagtactaagatgaattctacgttatcaagaccggctacttttccaaaactcatacttgtttgcaaacagtttccatttctgtcagaaagcttctggttttaaagctacttcaaatgacctttcattccaaaatttaaagaactaccaaatcatactgcttcagtaaccatctgatggaactagggtatagatagagaccccagattgaaaggttcagggctatagagaacccttgactagctgggatagaaactcacattgagaaatggtctccttagcgccacagcctgccagaaccttaggcagtacaaaaaggcaggcagtactggtctaattctcagatctgcaatcttagatgttgccagtggtccttaggttattggccagagaacttgggggttcaattctctgctttgcttcctaaaaacaccacttagagcaggggttaataacctctagcacttatatatggcatggcttgtctctttgttcctatgctacaatattttactccaaaagacactcatggggctaggcacagtggttcatacctataatcccagtactctgggaggccaaggcaagaggattacttgaccccaggggttcaagaccagcgtgggcaacatagtgtgaccccgtttctacaaaaaataattagccaggtgtcccaactacttgggaggttgaggctgcagtgagccatgattgtgccactgcactgttataatgctgtcaactagatacataaagcagtttgcttaatttatagggtggcaatagtctggaaacataagtcatgtatatatttctaatagtgcaaactttgatgaccacttctgggatatgctaaagg

SEQ ID NO: 361182 - DNA, 1680 bp, Homo sapiens
agaaccactcctatagatcagtaatgtgcaatgggatagaaagggctaatcagcagtattcctgctactaggtaagttaatgagaaaccaagacaaccttagagattttattcgtcttgagaaagcaatactgtgttcctcagctgcccttctgaaacatttccaccttgtgtcacttctccttcccagatcaagtgtgtcctgtgttgctctaaacttaccctgtgggtggcagaagaaagcagattgcatacccacggacgcacatgataatgatcttggtgagaacaagaattcttgattaatcctgtccatttctccctttcataggtaccacaactcccaggattttcctggatcaaaccttgtatctcttctgcaagtattgtgtatattggtctgagagacgtggaccctcctgaacattttattttaaagaactatgatatccagtatttttccatgagagatattgatcgacttggtatccagaaggtcatggaacgaacatttgatctgctgattggcaagagacaaagaccaatccatttgagttttgatattgatgcatttgaccctacactggctccagccacaggaactcctgttgtcgggggactaacctatcgagaaggcatgtatattgctgaggaaatacacaatacagggttgctatcagcactggatcttgttgaagtcaatcctcagttggccacctcagaggaagaggcgaagactacagctaacctggcagtagatgtgattgcttcaagctttggtcagacaagagaaggagggcatattgtctatgaccaacttcctactcccagttcaccagatgaatcagaaaatcaagcacgtgtgagaatttaggagacactgtgcactgacatgtttcacaacaggcattccagaattatgaggcattgaggggatagatgaatactaaatggttgtctgggtcaatactgccttaatgagaacatttacacattctcacaattgtaaagtttcccctctattttggtgaccaatactactgtaaatgtatttggttttttgcagttcacagggtattaatatgctacagtactatgtaaatttaaagaagtcataaacagcatttattaccttggtatatcatactggtcttgttgctgttgttccttcacatttaagtggtttttcatctttcctccctcctcccacagcctggctatacagtgcatccttgaactgtcagcccacagcagcaatatgcttattctatccacatccctaacatcatgcattcacaaggtcaaagttctggtccacaaacccttccctatagaagttcaatggctgcgaaagaatttgtagtaaaccaggcctcccaggatggcgagctccagtaagatgataatggaaagcagcagcttgttggttgtcactctacaaagagaagcaaagtggggagtagtcagaagtttggataaccttccttctaaacattttggggttagacctgggaccacggctggatactctgaggctgtatgtttgatcacacagccacttagcaggaagtactcataaggttctttagctgtcacttagggataacactgtctacctcacagaaatgttaaactgagacaataaaaaccaaagcataaaaatggattctgaaatgttgtt

SEQ ID NO: 361183 - DNA, 975 bp, Homo sapiens
cacggggcgggcggacgctggcgcgggtaggtaagagcagcggcgggcggtggcgctcactcccggcttccaaccgcgcggagcctctgccttggagattctcagtgctgcggatcatgtccctaaggggcagcctctcgcgtctcctccagacgcgagtgcattccatcctgaagaaatccgtccactccgtggctgtgataggagccccgttctcacaagggcagaaaagaaaaggagtggagcatggtcccgctgccataagagaagctggcttgatgaaaaggctctccagtttgggctgccacctaaaagactttggagatttgagttttactccagtccccaaagatgatctctacaacaacctgatagtgaatccacgctcagtgggtcttgccaaccaggaactggctgaggtggttagcagagctgtgtcagatggctacagctgtgtcacactgggaggagaccacagcctggcaatcggtaccattagtggccatgcccgacactgcccagacctttgtgttgtctgggttgatgcccatgctgacatcaacacaccccttaccacttcatcaggaaatctccatggacagccagtttcatttctcctcagagaactacaggataaggtcagtgggccaaaacgaaaagaaaggtgaatggcttgcagggttttgctggagttggtctagttcagttaagattttggtgaagggtgggttgagtgtggattaccactccttcatttgttcatcactattatggaccaggcagtctgccagatgctaggggtataaagactagacatagtctctgttctttgtaagaaagcaaggagggggtagtaacaatagcgactgatatacccacagcctgaggacttcttggttagaggctcccaggccatactctcagacacactgatctagaagacaaataaaaccatgacctctgggtaatattttc

SEQ ID NO: 361184 - DNA, 470 bp, Homo sapiens
ctaatggttaaccatttttttattgttgggttaagtcaatcgatatctcttagtttcagtttccaacatctgcaaaactgttcataataggatcgagataatcttcccacaatcatttgacattttaaattttactgtgacaaaatgattatgatgtgtactttgtcacgtattatcattgtggcccaggctagttaagagttggagatagcacagaaaattcatcttgtcatccctcatttgcttccaggctgccacctaaaagactttggagatttgagttttactccagtccccaaagatgatctctacaacaacctgatagtgaatccacgctcagtgggtcttgccaaccaggaactggctgaggtggttagcagagctgtgtcagatggctacagctgtgtcacactgggaggagaccacaggtaagctgggagccaggcgtggtgaggggatggattacatgg

SEQ ID NO: 361185 - DNA, 606 bp, Homo sapiens
gcgtgtcggggctgcgctgacagaggagcaggcagcagatgtagtctcgcttcgtcacccaggctggagtgcagtggcgcaatctcggctcactgcaacctccgcctcccaggttcaagtgattctcctgcttcagcctcccaggttcaagcgattctcctgcctcagcctcccaagtagctgggattacaggcgctcgccaccatgcccggctaattttttgtatttttagtagagatgggctgatgctgtcacaggttttcagaggaacctgctgggaactaaatgtaccaaatgggtttttttccgacaccttctctacctctaattgtgtaatttgtgtgactgacagaaaagaaaaggagtggagcatggtcccgctgccataagagaagctggcttgatgaaaaggctctccagtttgggtaagtggttagatttttagatattagtgcaggactagtaatagaccacttcagagtcttttctctgacatccagggactacacagctttgtgtttgggaacagtctgccacatcccgcatcctcctttggattccgtctgcggcttaagatcaaggagtcatcagggaaagtcttcttgc

SEQ ID NO: 361186 - DNA, 3507 bp, Homo sapiens
cacggggcgggcggacgctggcgcgggtaggtaagagcagcggcgggcggtggcgctcactcccggcttccaaccgcgcggagcctctgccttggagattctcagtgctgcggatcatgtccctaaggggcagcctctcgcgtctcctccagacgcgagtgcattccatcctgaagaaatccgtccactccgtggctgtgataggagccccgttctcacaagggcagaaaagaaaaggagtggagcatggtcccgctgccataagagaagctggcttgatgaaaaggctctccagtttgggctgccacctaaaagactttggagatttgagttttactccagtccccaaagatgatctctacaacaacctgatagtgaatccacgctcagtgggtcttgccaaccaggaactggctgaggtggttagcagagctgtgtcagatggctacagctgtgtcacactgggaggagaccacagcctggcaatcggtaccattagtggccatgcccgacactgcccagacctttgtgttgtctgggttgatgcccatgctgacatcaacacaccccttaccacttcatcaggaaatctccatggacagccagtttcatttctcctcagagaactacaggataaggtaccacaactcccaggattttcctggatcaaaccttgtatctcttctgcaagtattgtgtatattggtctgagagacgtggaccctcctgaacagtaagttgatgcatttggctgaagtttagggcctgtcctagccaattatgttctatttgaaaggctgatgcttaacttggtctattgcaggtcactacaacaaacccaccctctcccccaaatacatatttgttaaaaatgctctttaaactaaggactcctccctttatatctcatcacagttttattttaaagaactatgatatccagtatttttccatgagagatattgatcgacttggtatccagaaggtcatggaacgaacatttgatctgctgattggcaagtaagtaactataactgatgtcagggcaaacccccaatgggcaacacacttttagcctgtttcttgaggacagcagctttacttttaaaatacaaagcaaaaacatacacataattttaaatagttcagaaaggcaaaatttgaaacacaggtcatattcttcctctggggtttttgggaggaggtttcctctaaatcattgcctagatcttctgtctcatgaatttttctttatctccatctttaatgcttatcttctgagatgacaagcatttattgtttcaactgtcccattcttcccagcctcacgattgtttcatctgagttttatattaagcaaatcttggcagtgtagaaagatggcagatgaatactaatcaaatggtaattttaagagcattttcccaataccaagtctttacttctgggtgattaatgtcagaattgttatctggtagtatgtcatttcataagctgttaagaaacttagttgttagcttcagcctttggacactggggctataatgaagttagaaatggaagatgttaaaactgcagacctaaaattagagttcacttcagctgctgttacgttcagagaataagagcaaccataacttacatcaagccaatttaaattagactaatttaaattgtctaattaaattgtctctagatgagagcccaatctcatctagaagtgaagaaatctctctattgacagttattagtataagaggttctaatacccagtgtaaggcagaaatatacattggagttagtctgtctgaggtatgcagaacaaatggcagtatcatgaagtggtatgtaggaagttaatattgccaatctcagtaacttccaagaataggaagcctggaaatgtattaacagctttattaacaaagtactaggactaatagcaacaaaatcaaggaaagtattattttatcctcttcctttttaggagacaaagaccaatccatttgagttttgatattgatgcatttgaccctacactggctccagccacaggaactcctgttgtcgggggactaacctatcgagaaggcatgtatattgctgaggaaatacacaatacaggtatgtagcaaccaggtctgcagcctgttaactacataggtaaatatgctagagtctcttgcctgcaaaggatcttttctgctattccacatcattgcagagtttgtttttgcttaaacttttgtagctaaaaattatatggccatgctaataaaaaggatatagtcctttagagtcatgcttggacatggctcttaccaaattacactaaggtaataatgagtaaaaaattgtatatttaaacaattaaatacaagaataaattgtcaaactgatgcagttctttgagttatctaaaggcagattaagataagaaggcaagataagataagagtgcaaggctgtaatttgcactctaagagattggttcattgggagttgtgaatttggagctaaagctgatctcttgaagaaatctgcaaactggacaatatcttgggtcctttatgtagggtaggtcttgtactagagcctgaaaggatttctaataagggggatacagttagatgagaatggctgatggaaagagtactaagatgaattctacgttatcaagaccggctacttttccaaaactcatacttgtttgcaaacagtttccatttctgtcagaaagcttctggttttaaagctacttcaaatgacctttcattccaaaatttaaagaactaccaaatcatactgcttcagtaaccatctgatggaactagggtatagatagagaccccagattgaaaggttcagggctatagagaacccttgactagctgggatagaaactcacattgagaaatggtctccttagcgccacagcctgccagaaccttaggcagtacaaaaaggcaggcagtactggtctaattctcagatctgcaatcttagatgttgccagtggtccttaggttattggccagagaacttgggggttcaattctctgctttgcttcctaaaaacaccacttagagcaggggttaataacctctagcacttatatatggcatggcttgtctctttgttcctatgctacaatattttactccaaaagacactcatggggctaggcacagtggttcatacctataatcccagtactctgggaggccaaggcaagaggattacttgaccccaggggttcaagaccagcgtgggcaacatagtgtgaccccgtttctacaaaaaataattagccaggtgtcccaactacttgggaggttgaggctgcagtgagccatgattgtgccactgcactgttataatgctgtcaactagatacataaagcagtttgcttaatttatagggtggcaatagtctggaaacataagtcatgtatatatttctaatagtgcaaactttgatgaccacttctgggatatgctaaagg

SEQ ID NO: 361187 - DNA, 2170 bp, Homo sapiens
cacggggcgggcggacgctggcgcgggtaggtaagagcagcggcgggcggtggcgctcactcccggcttccaaccgcgcggagcctctgccttggagattctcagtgctgcggatcatgtccctaaggggcagcctctcgcgtctcctccagacgcgagtgcattccatcctgaagaaatccgtccactccgtggctgtgataggagccccgttctcacaagggcagaaaagaaaaggagtggagcatggtcccgctgccataagagaagctggcttgatgaaaaggctctccagtttgggctgccacctaaaagactttggagatttgagttttactccagtccccaaagatgatctctacaacaacctgatagtgaatccacgctcagtgggtcttgccaaccaggaactggctgaggtggttagcagagctgtgtcagatggctacagctgtgtcacactgggaggagaccacagcctggcaatcggtaccattagtggccatgcccgacactgcccagacctttgtgttgtctgggttgatgcccatgctgacatcaacacaccccttaccacttcatcaggaaatctccatggacagccagtttcatttctcctcagagaactacaggataaggtaccacaactcccaggattttcctggatcaaaccttgtatctcttctgcaagtattgtgtatattggtctgagagacgtggaccctcctgaacagtaagttgatgcatttggctgaagtttagggcctgtcctagccaattatgttctatttgaaaggctgatgcttaacttggtctattgcaggtcactacaacaaacccaccctctcccccaaatacatatttgttaaaaatgctctttaaactaaggactcctccctttatatctcatcacagttttattttaaagaactatgatatccagtatttttccatgagagatattgatcgacttggtatccagaaggtcatggaacgaacatttgatctgctgattggcaagagacaaagaccaatccatttgagttttgatattgatgcatttgaccctacactggctccagccacaggaactcctgttgtcgggggactaacctatcgagaaggcatgtatattgctgaggaaatacacaatacagggttgctatcagcactggatcttgttgaagtcaatcctcagttggccacctcagaggaagaggcgaagactacagctaacctggcagtagatgtgattgcttcaagctttggtcagacaagagaaggagggcatattgtctatgaccaacttcctactcccagttcaccagatgaatcagaaaatcaagcacgtgtgagaatttaggagacactgtgcactgacatgtttcacaacaggcattccagaattatgaggcattgaggggatagatgaatactaaatggttgtctgggtcaatactgccttaatgagaacatttacacattctcacaattgtaaagtttcccctctattttggtgaccaatactactgtaaatgtatttggttttttgcagttcacagggtattaatatgctacagtactatgtaaatttaaagaagtcataaacagcatttattaccttggtatatcatactggtcttgttgctgttgttccttcacatttaagtggtttttcatctttcctccctcctcccacagcctggctatacagtgcatccttgaactgtcagcccacagcagcaatatgcttattctatccacatccctaacatcatgcattcacaaggtcaaagttctggtccacaaacccttccctatagaagttcaatggctgcgaaagaatttgtagtaaaccaggcctcccaggatggcgagctccagtaagatgataatggaaagcagcagcttgttggttgtcactctacaaagagaagcaaagtggggagtagtcagaagtttggataaccttccttctaaacattttggggttagacctgggaccacggctggatactctgaggctgtatgtttgatcacacagccacttagcaggaagtactcataaggttctttagctgtcacttagggataacactgtctacctcacagaaatgttaaactgagacaataaaaaccaaagcataaaaatggattctgaaatgttgtt

SEQ ID NO: 361188 - DNA, 902 bp, Homo sapiens
cacggggcgggcggacgctggcgcgggtaggtaagagcagcggcgggcggtggcgctcactcccggcttccaaccgcgcggagcctctgccttggagattctcagtgctgcggatcatgtccctaaggggcagcctctcgcgtctcctccagacgcgagtgcattccatcctgaagaaatccgtccactccgtggctgtgataggagccccgttctcacaagggcagaaaagaaaaggagtggagcatggtcccgctgccataagagaagctggcttgatgaaaaggctctccagtttgggctgccacctaaaagactttggagatttgagttttactccagtccccaaagatgatctctacaacaacctgatagtgaatccacgctcagtgggtcttgccaaccaggaactggctgaggtggttagcagagctgtgtcagatggctacagctgtgtcacactgggaggagaccacagcctggcaatcggtaccattagtggccatgcccgacactgcccagacctttgtgttgtctgggttgatgcccatgctgacatcaacacaccccttaccacttcatcaggaaatctccatggacagccagtttcatttctcctcagagaactacaggataaggtaccacaactcccaggattttcctggatcaaaccttgtatctcttctgcaagtattgtgtatattggtctgagagacgtggaccctcctgaacatttcttttaagacacttgattccggatttccctgagaattgtcgactgggtccagagggttggacacattgccgctgtggccacaccatcccttgtctgcttctcctgacctacggcccagggacctgtggggaccctgacggtattgggaccacgggaccgacttatc

SEQ ID NO: 361189 - DNA, 1081 bp, Homo sapiens
  misc_feature (10)..(10): n is a, c, g, or t
gactctagangatccccacgtcgcaagctcatccagaaatcattattatttaataaaaaagatttctggaatgagggaaatgatcagtccattttagccagattagagttgcagtgctgtactttagtatgggtaaacagaaatgtatccagaaggagagaggggtgttcaggtcttctaagtagaagtcagacactcctcaaatattgtggataggggtcatggtttagagtagaaaattgggctaacagagaagctttgaattcccatagttaatactggaggaaatgagtcatcggtgataagcaaagccacacacaatattgttggttcttattgactgaatttactttggttgccttttaggtgagcccgtggtagcagcagaagcaggcattatgggataacgattgtgtaaagaaacagcttcttcattcctgcactggttgccaccaacattctcttggttgatgagatcatgcgagctggaatcttctctgaaaggttgaattgaagcttcctctgtatctgagtcttgaagactctgcaaagtgatcctgaagaatacagctgtggaatttttgtccaagcttcaaatgagctttcaagggaattttcccatgtgaaaaaaggagagaacactggcatctgttgaaattcggaagttctgaaattataattacagtattttttaaaaattgcactgaagtgtacacagataaagcaggtctttcacccagtgaacaggatgttttgctttagcagcagtgacataaaattccatgttaaataagcatatattacctaccttattaaatattccttgaaaaagcagattttaatggtttaattttatgtggacatatgttaaattattcagcagtaccctattgttaagcatctggttttaaaatttttatgctaatataaataacgcttagtaatttaaaattttggaagcatcccgttagtgtaaattctgagtaaatttattgatcagttggacttttcacgcttttgaaatagctttgctaaaatgctccccctacaaagttgtaggaaatgggaagaggagtaaact

SEQ ID NO: 361190 - DNA, 1117 bp, Homo sapiens
  misc_feature (10)..(10): n is a, c, g, or t
gactctagangatccccacgtcgcaagctcatccagaaatcattattatttaataaaaaagatttctggaatgagggaaatgatcagtccattttagccagattagagttgcagtgctgtactttagtatgggtaaacagaaatgtatccagaaggagagaggggtgttcaggtcttctaagtagaagtcagacactcctcaaatattgtggataggggtcatggtttagagtagaaaattgggctaacagagaagctttgaattcccatagttaatactggaggaaatgagtcatcggtgataagcaaagccacacacaatattgttggttcttattgactgaatttactttggttgccttttaggtgagcccgtggtagcagcagaagcaggcattatgggataacgattgtgtaaagaaacagcttcttcattcctgcactggttgccaccaacattctcttggttgatgagatcatgcgagctggaatcttctctgaaaggttgaattgaagcttcctctgtatctgagtcttgaagactctgcaaagtgatcctgaagaatacagctgtggaatttttgtccaagcttcaaatgagctttcaagggaattttcccatgtgaaaaaaggagagaacactggcatctgttgaaattcggaagttgagatctgtactcatccaccttaacaggagtcttggaagaagttcgacttcccacccttatggatgactcaggggtctacacttctctggaggaagtaatagccgatgtgatggaaatagcaagagaactagaattggagctcgagcctgcagatgtgaccgagctgcggccatcgcaagatgcatactcgaaccgatgatgtgttccttctgaagaataagccaagatagtagtttcttgagatggaatttactgctgttgagaatgctgtgaacactgttgaaatgacaaccaaggatttagaatattacataagcttagttgataaagcacgcggcagggtttgagaggattaactcccattcttgaaagaagttctactgtgcggtcaaatgctatcaccggcattgtatggtacagagacctttgtgggtggcatcgataaaccc

SEQ ID NO: 361191 - DNA, 1070 bp, Homo sapiens
cacccccagccgaaagctattccagaaatcattattatttaataaaaaagatttctggaatgagggaaatgatcagtccattttagccagattagagttgcagtgctgtactttagtatgggtaaacagaaatgtatccagaaggagagaggggtgttcaggtcttctaagtagaagtcagacactcctcaaatattgtggataggggtcatggtttagagtagaaaattgggctaacagagaagctttgaattcccatagttaatactggaggaaatgagtcatcggtgataagcaaagccacacacaatattgttggttcttattgactgaatttactttggttgccttttaggtgagcccgtggtagcagcagaagcaggcattatgggataacgattgtgtaaagaaacagcttcttcattcctgcactggttgccaccaacattctcttggttgatgagatcatgcgagctggaatcttctctgaaaggttgaattgaagcttcctctgtatctgagtcttgaagactctgcaaagtgatcctgaagaatacagctgtggaatttttgtccaagcttcaaatgagctttcaagggaattttcccatgtgaaaaaaggagagaacactggcatctgttgaaattcggaagttctgaaattataattacagtattttttaaaaattgcactgaagtgtacacagataaagcaggtctttcacccagtgaacaggatgttttgctttagcagcagtgacataaaattccatgttaaataagcatatattacctaccttattaaatattccttgaaaaagcagattttaatggtttaattttatgtggacatatgttaaattattcagcagtaccctattgttaagcatctggttttaaaatttttatgctaatataaataacgcttagtaatttaaaattttggaagcatcccgttagtgtaaattctgagtaaatttattgatcagttggacttttcacgcttttgaaatagctttgctaaaatgctccccctacaaagttgtaggaaatgggaagaggagtaaact

SEQ ID NO: 361192 - DNA, 1560 bp, Homo sapiens
tgagacggagtcttgctctgttgcccaggctggagtgcagtggcaagatcttggctcactgcaactgctgcctcccaggttcacgccattctcctgcctcagcctcccgagtagctgggactacaggcacctgccaccacgcctggctaattttttgtatttttagttgagatggggtttcaccatgttagccaggatggtctcgatctcctgacctcatgatctgcccgcctcagcctcccaaaatgctgggattacaggcgtgaagcaccgcacccggccaccttactcagtttttaatcaagtactatgataagaaaatagattgggtgattatattcatgggtgaaaaacagctaaagatagcaaataatgccagaagaggggatctagaaatctaatgaaatggtgacagccctgatcttaggcccctgtaacaaaacaacacaaattaagtacaaagtaggagacagataacaggtacatccatgcagtatgtgcaagacctattgctgtcaacattattatttaataaaaaagatttctggaatgagggaaatgatcagtccattttagccagattagagttgcagtgctgtactttagtatgggtaaacagaaatgtatccagaaggagagaggggtgttcaggtcttctaagtagaagtcagacactcctcaaatattgtggataggggtcatggtttagagtagaaaattgggctaacagagaagctttgaattcccatagttaatactggaggaaatgagtcatcggtgataagcaaagccacacacaatattgttggttcttattgactgaatttactttggttgccttttaggtgagcccgtggtagcagcagaagcaggcattatgggataacgattgtgtaaagaaacagcttcttcattcctgcactggttgccaccaacattctcttggttgatgagatcatgcgagctggaatcttctctgaaaggttgaattgaagcttcctctgtatctgagtcttgaagactctgcaaagtgatcctgaagaatacagctgtggaatttttgtccaagcttcaaatgagctttcaagggaattttcccatgtgaaaaaaggagagaacactggcatctgttgaaattcggaagttctgaaattataattacagtattttttaaaaattgcactgaagtgtacacagataaagcaggtctttcacccagtgaacaggatgttttgctttagcagcagtgacataaaattccatgttaaataagcatatattacctaccttattaaatattccttgaaaaagcagattttaatggtttaattttatgtggacatatgttaaattattcagcagtaccctattgttaagcatctggttttaaaatttttatgctaatataaataacgcttagtaatttaaaattttggaagcatcccgttagtgtaaattctgagtaaatttattgatcagttggacttttcacgcttttgaaatagctttgctaaaatgctccccctacaaagttgtaggaaatgggaagaggagtaaact

SEQ ID NO: 361193 - DNA, 2081 bp, Homo sapiens
cgcgccgacttttccggaagatccggatagtgcatcccggccacggcgcgcctgctctgggctctccgcgtgccgcgtcgctttcttttcttcctctggagcagttatggcggcggcgaagaccctgaaccccaaggccaaggtggccggagcgcaggcggcgctggcgttcaacattagcggggcgcggggtctgcaggacgtgctgaggaccaacctggggcccaaagggaccataaagatcaaattcaacacccaacagcttccttaatagcaaaggtagcaacagcccaggatgatataactggtgatggtacgacttccaatgtcctaatcattggagagctgctgaaacaggcagatctctacatttctgaaggccttcatcccagaataatcactgaaggatttgaagctgtgaaggaaaagcccttcattttttggaagaagtcaaagtaagcagagagatggacaaggaaacacttaaagatgtggccagggcatctctttgtactaaagttcatgctgaacttgcagatgtcttaacagaggctgtagtgggctccattttggccattaaaagaaaagatgaacctattgatctcttcatgattttgtgatcattgacaagaaacataaatctgaaactgatacaagagaagtgaattctggcgttttttacaagagtgcagaaagagaaaaactcataaaagctgaaagaaaattcattgaagatagagttaaaacaaataatagaactgaaaaggaaagtctgtagtaattcagataaaggatttgttattaatcaaaagggaattgaccccttttccttagatgctctttcaaagaaggcatagtcgctcttcacagagctaaaaggaggaatatggagaggctgactcttgcttgtggtggggtggccctgaattcttttgaggacctaagtcctgactgcttgagacatgcaggacttgtatatgagtatacattgggagaagttcacctttattgagaagtgtaacaaccctcgttctgtcacattattgatcaaaggaccaaataagcccacacttagatcaaagatgcagtaagggatggcttgagggctgtcaaaaatgctattgatgatggctgtgtggttccggtgctggtgccgtggaagtggcaatggcagaagccctgaataaatataagctcagtgtaaagggcaaggcacagcttggagtccaagcatttgctgatgtgttgctcgttattcccaaggttcttgcgcagaattctggttttgaccttcaggaaacattagttaaaatttaagcagaacattcagaatcaggtcagctcgtgggtgtggacctgaacacaggtgagcccgtggtagcagcagaagcaggcattatgggataacgattgtgtaaagaaacagcttcttcattcctgcactggttgccaccaacattctcttggttgatgagatcatgcgagctggaatcttctctgaaaggttgaattgaagcttcctctgtatctgagtcttgaagactctgcaaagtgatcctgaagaatacagctgtggaatttttgtccaagcttcaaatgagctttcaagggaattttcccatgtgaaaaaaggagagaacactggcatctgttgaaattcggaagttctgaaattataattacagtattttttaaaaattgcactgaagtgtacacagataaagcaggtctttcacccagtgaacaggatgttttgctttagcagcagtgacataaaattccatgttaaataagcatatattacctaccttattaaatattccttgaaaaagcagattttaatggtttaattttatgtggacatatgttaaattattcagcagtaccctattgttaagcatctggttttaaaatttttatgctaatataaataacgcttagtaatttaaaattttggaagcatcccgttagtgtaaattctgagtaaatttattgatcagttggacttttcacgcttttgaaatagctttgctaaaatgctccccctacaaagttgtaggaaatgggaagaggagtaaact

SEQ ID NO: 361194 - DNA, 1820 bp, Homo sapiens
tgagacggagtcttgctctgttgcccaggctggagtgcagtggcaagatcttggctcactgcaactgctgcctcccaggttcacgccattctcctgcctcagcctcccgagtagctgggactacaggcacctgccaccacgcctggctaattttttgtatttttagttgagatggggtttcaccatgttagccaggatggtctcgatctcctgacctcatgatctgcccgcctcagcctcccaaaatgctgggattacaggcgtgaagcaccgcacccggccaccttactcagtttttaatcaagtactatgataagaaaatagattgggtgattatattcatgggtgaaaaacagctaaagatagcaaataatgccagaagaggggatctagaaatctaatgaaatggtgacagccctgatcttaggcccctgtaacaaaacaacacaaattaagtacaaagtaggagacagataacaggtacatccatgcagtatgtgcaagacctattgctgtcaacattattatttaataaaaaagatttctggaatgagggaaatgatcagtccattttagccagattagagttgcagtgctgtactttagtatgggtaaacagaaatgtatccagaaggagagaggggtgttcaggtcttctaagtagaagtcagacactcctcaaatattgtggataggggtcatggtttagagtagaaaattgggctaacagagaagctttgaattcccatagttaatactggaggaaatgagtcatcggtgataagcaaagccacacacaatattgttggttcttattgactgaatttactttggttgccttttaggtgagcccgtggtagcagcagaagcaggcattatgggataacgattgtgtaaagaaacagcttcttcattcctggtaagtttgggaaaatgaaaactaaactgttagagaatcatcatactcttcatttggtgttttctgtttagttgctcattttcccccatgaataatgtaatcagctgaaagtatggaaaccgaactagccctctgatgtgtagaggggaagggggaaatttaattggatgttaacgtgtgcagcttagttggaagtgggaagttgagtcgaattagggctcctaatcatctgagctatctaatttttatccccctttcagcactggttgccaccaacattctcttggttgatgagatcatgcgagctggaatcttctctgaaaggttgaattgaagcttcctctgtatctgagtcttgaagactctgcaaagtgatcctgaagaatacagctgtggaatttttgtccaagcttcaaatgagctttcaagggaattttcccatgtgaaaaaaggagagaacactggcatctgttgaaattcggaagttctgaaattataattacagtattttttaaaaattgcactgaagtgtacacagataaagcaggtctttcacccagtgaacaggatgttttgctttagcagcagtgacataaaattccatgttaaataagcatatattacctaccttattaaatattccttgaaaaagcagattttaatggtttaattttatgtggacatatgttaaattattcagcagtaccctattgttaagcatctggttttaaaatttttatgctaatataaataacgcttagtaatttaaaattttggaagcatcccgttagtgtaaattctgagtaaatttattgatcagttggacttttcacgcttttgaaatagctttgctaaaatgctccccctacaaagttgtaggaaatgggaagaggagtaaact

SEQ ID NO: 361195 - DNA, 1753 bp, Homo sapiens
tgagacggagtcttgctctgttgcccaggctggagtgcagtggcaagatcttggctcactgcaactgctgcctcccaggttcacgccattctcctgcctcagcctcccgagtagctgggactacaggcacctgccaccacgcctggctaattttttgtatttttagttgagatggggtttcaccatgttagccaggatggtctcgatctcctgacctcatgatctgcccgcctcagcctcccaaaatgctgggattacaggcgtgaagcaccgcacccggccaccttactcagtttttaatcaagtactatgataagaaaatagattgggtgattatattcatgggtgaaaaacagctaaagatagcaaataatgccagaagaggggatctagaaatctaatgaaatggtgacagccctgatcttaggcccctgtaacaaaacaacacaaattaagtacaaagtaggagacagataacaggtacatccatgcagtatgtgcaagacctattgctgtcaacattattatttaataaaaaagatttctggaatgagggaaatgatcagtccattttagccagattagagttgcagtgctgtactttagtatgggtaaacagaaatgtatccagaaggagagaggggtgttcaggtcttctaagtagaagtcagacactcctcaaatattgtggataggggtcatggtttagagtagaaaattgggctaacagagaagctttgaattcccatagttaatactggaggaaatgagtcatcggtgataagcaaagccacacacaatattgttggttcttattgactgaatttactttggttgccttttaggtgagcccgtggtagcagcagaagcaggcattatgggataacgattgtgtaaagaaacagcttcttcattcctggtaagtttgggaaaatgaaaactaaactgttagagaatcatcatactcttcatttggtgttttctgtttagttgctcattttcccccatgaataatgtaatcagctgaaagtatggaaaccgaactagccctctgatgtgtagaggggaagggggaaatttaattggatgttaacgtgtgcagcttagttggaagtgggaagttgagtcgaattagggctcctaatcatctgagctatctaatttttatccccctttcagcactggttgccaccaacattctcttggttgatgagatcatgcgagctggaatcttctctgaaaggttgaattgaagcttcctctgtatctgagtcttgaagactctgcaaagtgatcctgaagaatacagctgtggaatttttgtccaagcttcaaatgagctttcaagggaattttcccatgtgaaaaaaggagagaacactggcatctgttgaaattcggaagttccaggctcagctgaggcgagtgcgcggccagggctgcagctggcgctggctggtacttgctcaggccattgaggagcttctgggcgaccctgcgctcgtgcctaccaggcgccagccagtaggtgcgcagcgcctgctccagcagcgtcaagcctttgctgcgcggaccccgcaggccgggaagtcacgcaggtggtagtagtccaggtggtcgtaaactcctcctcatagcttatgggtggcggcggctgggctgaagactgcggacaggacatcccgcccggccgcctgtggtcaccctcccgcgcaggcgcgctcctggaagacccagcacctggagttccgat

SEQ ID NO: 361196 - DNA, 2060 bp, Homo sapiens
gtagcccaggctggtttcgaattcctgagttcaagggatccatctgctgtggcctcccaaagtgctgggattacaggcatgagctaacgcacctgacctttccttttaaattacttggccattgcagagtaacagtggaggctgctgagctttcattttaggagatacctggcttattctcgtagagccctacacttgcctaaagaggcaaggatgtaaaattatccgttactgttaactgttagctgtcatcttgcgtaaactttcactgagcctcaagcttcctcatctgtaaagtagagataacctgggaaataaattacacatgaaaatgtttccatcattataattgcatgcgcatgatagcaaattgtgactttttaatcttagtaatttgtagccaaacacttgggtagctttttcaagtagatagtacttaaagaggcccttcatgcattttatttgtggtatttttagactgtttcatattgttttaagtgattcgttctttttctactttcagcaaattcaacacccaacagcttccttaatagcaaaggtagcaacagcccaggatgatataactggtgatggtacgacttccaatgtcctaatcattggagagctgctgaaacaggcagatctctacatttctgaagtatgcacaacttttttttgttttgtttttttgagatgggatttcactcttgttgcccaggctggggtgcaatggcatctcggctcactgcaacgtctgtctcctgggttcaagcaattcccagcctcagcctcctcagtagctgagattacaggcatgagccactgtgcctggttcatgaagtctttagcagaaaaatcaattgaaattcaggatcagatttttgtttatatacattttgaaggtttatgtgtagtaatgggaagccatttatatgtgatttttcaaaaagataatttggtttgatgtgatcaagtttgttccttattaatatgctgcttgtcattctctgtaagtccctcttctctctttgcacacatcgtgtttttgaaaatcatgtttcttctacacaaagggagaagttcacctttattgagaagtgtaacaaccctcgttctgtcacattattgatcaaaggaccaaataagcccacacttagatcaaagatgcagtaagggatggcttgagggctgtcaaaaatgctattgatgatggctgtgtggttccggtgctggtgccgtggaagtggcaatggcagaagccctgaataaatataagctcagtgtaaagggcaaggcacagcttggagtccaagcatttgctgatgtgttgctcgttattcccaaggtgagcccgtggtagcagcagaagcaggcattatgggataacgattgtgtaaagaaacagcttcttcattcctgcactggttgccaccaacattctcttggttgatgagatcatgcgagctggaatcttctctgaaaggttgaattgaagcttcctctgtatctgagtcttgaagactctgcaaagtgatcctgaagaatacagctgtggaatttttgtccaagcttcaaatgagctttcaagggaattttcccatgtgaaaaaaggagagaacactggcatctgttgaaattcggaagttctgaaattataattacagtattttttaaaaattgcactgaagtgtacacagataaagcaggtctttcacccagtgaacaggatgttttgctttagcagcagtgacataaaattccatgttaaataagcatatattacctaccttattaaatattccttgaaaaagcagattttaatggtttaattttatgtggacatatgttaaattattcagcagtaccctattgttaagcatctggttttaaaatttttatgctaatataaataacgcttagtaatttaaaattttggaagcatcccgttagtgtaaattctgagtaaatttattgatcagttggacttttcacgcttttgaaatagctttgctaaaatgctccccctacaaagttgtaggaaatgggaagaggagtaaact

SEQ ID NO: 361197 - DNA, 1606 bp, Homo sapiens
cgcgccgacttttccggaagatccggatagtgcatcccggccacggcgcgcctgctctgggctctccgcgtgccgcgtcgctttcttttcttcctctggagcagttatggcggcggcgaagaccctgaaccccaaggccaaggtggccggagcgcaggcggcgctggcgttcaacattagcggggcgcggggtctgcaggacgtgctgaggaccaacctggggcccaaagggaccataaagatggccttcatcccagaataatcactgaaggatttgaagctgtgaaggaaaagcccttcattttttggaagaagtcaaagtaagcagagagatggacaaggaaacacttaaagatgtggccagggcatctctttgtactaaagttcatgctgaacttgcagatgtcttaacagaggctgtagtgggctccattttggccattaaaagaaaagatgaacctattgatctcttcatgattttgtgatcattgacaagaaacataaatctgaaactgatacaaggctgactcttgcttgtggtggggtggccctgaattcttttgaggacctaagtcctgactgcttgagacatgcaggacttgtatatgagtatacattgggagaagttcacctttattgagaagtgtaacaaccctcgttctgtcacattattgatcaaaggaccaaataagcccacacttagatcaaagatgcagtaagggatggcttgagggctgtcaaaaatgctattgatgatggctgtgtggttccggtgctggtgccgtggaagtggcaatggcagaagccctgaataaatataagctcagtgtaaagggcaaggcacagcttggagtccaagcatttgctgatgtgttgctcgttattcccaaggtgagcccgtggtagcagcagaagcaggcattatgggataacgattgtgtaaagaaacagcttcttcattcctgcactggttgccaccaacattctcttggttgatgagatcatgcgagctggaatcttctctgaaaggttgaattgaagcttcctctgtatctgagtcttgaagactctgcaaagtgatcctgaagaatacagctgtggaatttttgtccaagcttcaaatgagctttcaagggaattttcccatgtgaaaaaaggagagaacactggcatctgttgaaattcggaagttctgaaattataattacagtattttttaaaaattgcactgaagtgtacacagataaagcaggtctttcacccagtgaacaggatgttttgctttagcagcagtgacataaaattccatgttaaataagcatatattacctaccttattaaatattccttgaaaaagcagattttaatggtttaattttatgtggacatatgttaaattattcagcagtaccctattgttaagcatctggttttaaaatttttatgctaatataaataacgcttagtaatttaaaattttggaagcatcccgttagtgtaaattctgagtaaatttattgatcagttggacttttcacgcttttgaaatagctttgctaaaatgctccccctacaaagttgtaggaaatgggaagaggagtaaact

SEQ ID NO: 361198 - DNA, 1687 bp, Homo sapiens
aaaaaagcggctctagtgtgcggcgttccccgccttcttgggcttccagacaccctgaggactctgcacaatctctgcggggacgggggccttcatcccagaataatcactgaaggatttgaagctgtgaaggaaaagcccttcattttttggaagaagtcaaagtaagcagagagatggacaaggaaacacttaaagatgtggccagggcatctctttgtactaaagttcatgctgaacttgcagatgtcttaacagaggctgtagtgggctccattttggccattaaaagaaaagatgaacctattgatctcttcatgattttgtgatcattgacaagaaacataaatctgaaactgatacaagagaagtgaattctggcgttttttacaagagtgcagaaagagaaaaactcataaaagctgaaagaaaattcattgaagatagagttaaaacaaataatagaactgaaaaggaaagtctgtagtaattcagataaaggatttgttattaatcaaaagggaattgaccccttttccttagatgctctttcaaagaaggcatagtcgctcttcacagagctaaaaggaggaatatggagaggctgactcttgcttgtggtggggtggccctgaattcttttgaggacctaagtcctgactgcttgagacatgcaggacttgtatatgagtatacattgggagaagttcacctttattgagaagtgtaacaaccctcgttctgtcacattattgatcaaaggaccaaataagcccacacttagatcaaagatgcagtaagggatggcttgagggctgtcaaaaatgctattgatgatggctgtgtggttccggtgctggtgccgtggaagtggcaatggcagaagccctgaataaatataagctcagtgtaaagggcaaggcacagcttggagtccaagcatttgctgatgtgttgctcgttattcccaaggtgagcccgtggtagcagcagaagcaggcattatgggataacgattgtgtaaagaaacagcttcttcattcctgcactggttgccaccaacattctcttggttgatgagatcatgcgagctggaatcttctctgaaaggttgaattgaagcttcctctgtatctgagtcttgaagactctgcaaagtgatcctgaagaatacagctgtggaatttttgtccaagcttcaaatgagctttcaagggaattttcccatgtgaaaaaaggagagaacactggcatctgttgaaattcggaagttctgaaattataattacagtattttttaaaaattgcactgaagtgtacacagataaagcaggtctttcacccagtgaacaggatgttttgctttagcagcagtgacataaaattccatgttaaataagcatatattacctaccttattaaatattccttgaaaaagcagattttaatggtttaattttatgtggacatatgttaaattattcagcagtaccctattgttaagcatctggttttaaaatttttatgctaatataaataacgcttagtaatttaaaattttggaagcatcccgttagtgtaaattctgagtaaatttattgatcagttggacttttcacgcttttgaaatagctttgctaaaatgctccccctacaaagttgtaggaaatgggaagaggagtaaact

SEQ ID NO: 361199 - DNA, 1967 bp, Homo sapiens
cgcgccgacttttccggaagatccggatagtgcatcccggccacggcgcgcctgctctgggctctccgcgtgccgcgtcgctttcttttcttcctctggagcagttatggcggcggcgaagaccctgaaccccaaggccaaggtggccggagcgcaggcggcgctggcgttcaacattagcggggcgcggggtctgcaggacgtgctgaggaccaacctggggcccaaagggaccataaagatcaaattcaacacccaacagcttccttaatagcaaaggtagcaacagcccaggatgatataactggtgatggtacgacttccaatgtcctaatcattggagagctgctgaaacaggcagatctctacatttctgaaggccttcatcccagaataatcactgaaggatttgaagctgtgaaggaaaagcccttcattttttggaagaagtcaaagtaagcagagagatggacaaggaaacacttaaagatgtggccagggcatctctttgtactaaagttcatgctgaacttgcagatgtcttaacagaggctgtagtgggctccattttggccattaaaagaaaagatgaacctattgatctcttcatgattttgtgatcattgacaagaaacataaatctgaaactgatacaagagaagtgaattctggcgttttttacaagagtgcagaaagagaaaaactcataaaagctgaaagaaaattcattgaagatagagttaaaacaaataatagaactgaaaaggaaagtctgtagtaattcagataaaggatttgttattaatcaaaagggaattgaccccttttccttagatgctctttcaaagaaggcatagtcgctcttcacagagctaaaaggaggaatatggagaggctgactcttgcttgtggtggggtggccctgaattcttttgaggacctaagtcctgactgcttgagacatgcaggacttgtatatgagtatacattgggagaagttcacctttattgagaagtgtaacaaccctcgttctgtcacattattgatcaaaggaccaaataagcccacacttagatcaaagatgcagtaagggatggcttgagggctgtcaaaaatgctattgatgatggctgtgtggttccggtgctggtgccgtggaagtggcaatggcagaagccctgaataaatataagctcagtgtaaagggcaaggcacagcttggagtccaagcatttgctgatgtgttgctcgttattcccaaggtgtgtatgccttaaacagtcaatcttccaaaagattcagctgatcaaaactttttgataatgtaggctttattcataatacggattttggataaacgggtttgatcagttttcttcctgactataaaacatccaaacgtatttggtttctctgggaggcctgaatagctgacgtttcagatggcaagagagaacctgtagcttaatatttgcagtattaggggttatacttgagtaccaacttgctttttgttttggttttagctaaactgatatcattgttttttattatatactaattttgaagtatagtttatgactgatgtattgctgctgggtttggggtagatgagagagttgatcagtaacttgtgtctggttattctctgaagggaacataaatgttctgtcttcatgcaatgagattcttgttttgttttgttttgtttttaagaattttgagagttttgctcttgttgtccaggctggagtgcaatggtgtgatctcggcccactgcaacctcagcctccccagtagctgggattacaggcacctgccaccacactcagctaggtttcttttgtatttgtagtagaggtggggtttcaccatgttggccagactggtctcatactcctggcctcaggcgatccacctggcttggcctcccaaagtgctgggattacaggcatgagccactgca

SEQ ID NO: 361200 - DNA, 1590 bp, Homo sapiens
tgagacggagtcttgctctgttgcccaggctggagtgcagtggcaagatcttggctcactgcaactgctgcctcccaggttcacgccattctcctgcctcagcctcccgagtagctgggactacaggcacctgccaccacgcctggctaattttttgtatttttagttgagatggggtttcaccatgttagccaggatggtctcgatctcctgacctcatgatctgcccgcctcagcctcccaaaatgctgggattacaggcgtgaagcaccgcacccggccaccttactcagtttttaatcaagtactatgataagaaaatagattgggtgattatattcatgggtgaaaaacagctaaagatagcaaataatgccagaagaggggatctagaaatctaatgaaatggtgacagccctgatcttaggcccctgtaacaaaacaacacaaattaagtacaaagtaggagacagataacaggtacatccatgcagtatgtgcaagacctattgctgtcaacattattatttaataaaaaagatttctggaatgagggaaatgatcagtccattttagccagattagagttgcagtgctgtactttagtatgggtaaacagaaatgtatccagaaggagagaggggtgttcaggtcttctaagtagaagtcagacactcctcaaatattgtggataggggtcatggtttagagtagaaaattgggctaacagagaagctttgaattcccatagttaatactggaggaaatgagtcatcggtgataagcaaagccacacacaatattgttggttcttattgactgaatttactttggttgccttttaggtgagcccgtggtagcagcagaagcagcttagttggaagtgggaagttgagtcgaattagggctcctaatcatctgagctatctaatttttatccccctttcagcactggttgccaccaacattctcttggttgatgagatcatgcgagctggaatcttctctgaaaggttgaattgaagcttcctctgtatctgagtcttgaagactctgcaaagtgatcctgaagaatacagctgtggaatttttgtccaagcttcaaatgagctttcaagggaattttcccatgtgaaaaaaggagagaacactggcatctgttgaaattcggaagttctgaaattataattacagtattttttaaaaattgcactgaagtgtacacagataaagcaggtctttcacccagtgaacaggatgttttgctttagcagcagtgacataaaattccatgttaaataagcatatattacctaccttattaaatattccttgaaaaagcagattttaatggtttaattttatgtggacatatgttaaattattcagcagtaccctattgttaagcatctggttttaaaatttttatgctaatataaataacgcttagtaatttaaaattttggaagcatcccgttagtgtaaattctgagtaaatttattgatcagttggacttttcacgcttttgaaatagctttgctaaaatgctccccctacaaagttgtaggaaatgggaagaggagtaaact

SEQ ID NO: 361201 - DNA, 1407 bp, Homo sapiens
tgagacggagtcttgctctgttgcccaggctggagtgcagtggcaagatcttggctcactgcaactgctgcctcccaggttcacgccattctcctgcctcagcctcccgagtagctgggactacaggcacctgccaccacgcctggctaattttttgtatttttagttgagatggggtttcaccatgttagccaggatggtctcgatctcctgacctcatgatctgcccgcctcagcctcccaaaatgctgggattacaggcgtgaagcaccgcacccggccaccttactcagtttttaatcaagtactatgataagaaaatagattgggtgattatattcatgggtgaaaaacagctaaagatagcaaataatgccagaagaggggatctagaaatctaatgaaatggtgacagccctgatcttaggcccctgtaacaaaacaacacaaattaagtacaaagtaggagacagataacaggtacatccatgcagtatgtgcaagacctattgctgtcaacattattatttaataaaaaagatttctggaatgagggaaatgatcagtccattttagccagattagagttgcagtgctgtactttagtatgggtaaacagaaatgtatccagaaggagagaggggtgttcaggtcttctaagtagaagtcagacactcctcaaatattgtggataggggtcatggtttagagtagaaaattgggctaacagagaagctttgaattcccatagttaatactggaggaaatgagtcatcggtgataagcaaagccacacacaatattgttggttcttattgactgaatttactttggttgccttttaggtgagcccgtggtagcagcagaagcaggcattatgggataacgattgtgtaaagaaacagcttcttcattcctggtaagtttgggaaaatgaaaactaaactgttagagaatcatcatactcttcatttggtgttttctgtttagttgctcattttcccccatgaataatgtaatcagctgaaagtatggaaaccgaactagccctctgatgttcagtgaagaggaccagaaaagtctgctagagcagtaccatctgggtctggatctaatacgcagtatatacttggttggagagctcatctggaattttgccgttttcatgactgaccagtgtaagtggcagtttagcgcatgggattatgtacccgtcctcattttttcaggttgcctcgcacattctggacattttggctgtaagaatattggatacaagcgggggtacctggtttatacatgtagtttgtgttgataattttcctaggaaaagtaagttgtgcttaggaagtaggaaagcaatcaggccccgcttcccacgtacgtctactctctgagtagagatcg

SEQ ID NO: 361202 - DNA, 598 bp, Homo sapiens
gcgcaggcggcgctggcgttcaacattagcggggcgcggggtctgcaggacgtgctgaggaccaacctggggcccaaagggaccataaagatgtaaggtggggctggcgggagggctgggtgggcaccgcgcgccgctgcgcacctggcgggcccaagaccgcagatgggagcccgctgcctcggggctccgcagccacccttcctcgcgtcctcccgggccggtcctgttccctgctaagccccaccgttgcgtccatttcttcctgcgtcgatgccgtctccatggagaaaaaagcggctctagtgtgcggcgttccccgccttcttgggcttccagacaccctgaggactctgcacaatctctgcggggacggggtgggcactacacttgtcctccagcctgcgggagataactagctccatattctcggctccctaagatcggggaaaagcccgttttctaatgggactttttaatttagttttcgttgataactagctccatatccctggctccctgagatctgggaaaagtccttttttgttgtttgttttggttttttgttgtttttttttttgagacagagtctcgctct

SEQ ID NO: 361203 - DNA, 1978 bp, Homo sapiens
cgcgccgacttttccggaagatccggatagtgcatcccggccacggcgcgcctgctctgggctctccgcgtgccgcgtcgctttcttttcttcctctggagcagttatggcggcggcgaagaccctgaaccccaaggccaaggtggccggagcgcaggcggcgctggcgttcaacattagcggggcgcggggtctgcaggacgtgctgaggaccaacctggggcccaaagggaccataaagatcaaattcaacacccaacagcttccttaatagcaaaggtagcaacagcccaggatgatataactggtgatggtacgacttccaatgtcctaatcattggagagctgctgaaacaggcagatctctacatttctgaaggccttcatcccagaataatcactgaaggatttgaagctgtgaaggaaaagcccttcattttttggaagaagtcaaagtaagcagagagatggacaaggaaacacttaaagatgtggccagggcatctctttgtactaaagttcatgctgaacttgcagatgtcttaacagaggctgtagtgggctccattttggccattaaaagaaaagatgaacctattgatctcttcatgattttgtgatcattgacaagaaacataaatctgaaactgatacaagagaagtgaattctggcgttttttacaagagtgcagaaagagaaaaactcataaaagctgaaagaaaattcattgaagatagagttaaaacaaataatagaactgaaaaggaaagtctgtagtaattcagataaaggatttgttattaatcaaaagggaattgaccccttttccttagatgctctttcaaagaaggcatagtcgctcttcacagagctaaaaggaggaatatggagaggctgactcttgcttgtggtggggtggccctgaattcttttgaggacctaagtcctgactgcttgagacatgcaggacttgtatatgagtatacattgggagaagttcacctttattgagaagtgtaacaaccctcgttctgtcacattattgatcaaaggaccaaataagcccacacttagatcaaagatgcagtaagggatggcttgagggctgtcaaaaatgctattgatgatggctgtgtggttccggtgctggtgccgtggaagtggcaatggcagaagccctgaataaatataagctcagtgtaaagggcaaggcacagcttggagtccaagcatttgctgatgtgttgctcgttattcccaaggtgagcccgtggtagcagcagaagcaggcattatgggataacgattgtgtaaagaaacagcttcttcattcctgcactggttgccaccaacattctcttggttgatgagatcatgcgagctggaatcttctctgaaaggttgaattgaagcttcctctgtatctgagtcttgaagactctgcaaagtgatcctgaagaatacagctgtggaatttttgtccaagcttcaaatgagctttcaagggaattttcccatgtgaaaaaaggagagaacactggcatctgttgaaattcggaagttctgaaattataattacagtattttttaaaaattgcactgaagtgtacacagataaagcaggtctttcacccagtgaacaggatgttttgctttagcagcagtgacataaaattccatgttaaataagcatatattacctaccttattaaatattccttgaaaaagcagattttaatggtttaattttatgtggacatatgttaaattattcagcagtaccctattgttaagcatctggttttaaaatttttatgctaatataaataacgcttagtaatttaaaattttggaagcatcccgttagtgtaaattctgagtaaatttattgatcagttggacttttcacgcttttgaaatagctttgctaaaatgctccccctacaaagttgtaggaaatgggaagaggagtaaact

SEQ ID NO: 361204 - DNA, 1843 bp, Homo sapiens
cgcgccgacttttccggaagatccggatagtgcatcccggccacggcgcgcctgctctgggctctccgcgtgccgcgtcgctttcttttcttcctctggagcagttatggcggcggcgaagaccctgaaccccaaggccaaggtggccggagcgcaggcggcgctggcgttcaacattagcggggcgcggggtctgcaggacgtgctgaggaccaacctggggcccaaagggaccataaagatggccttcatcccagaataatcactgaaggatttgaagctgtgaaggaaaagcccttcattttttggaagaagtcaaagtaagcagagagatggacaaggaaacacttaaagatgtggccagggcatctctttgtactaaagttcatgctgaacttgcagatgtcttaacagaggctgtagtgggctccattttggccattaaaagaaaagatgaacctattgatctcttcatgattttgtgatcattgacaagaaacataaatctgaaactgatacaagagaagtgaattctggcgttttttacaagagtgcagaaagagaaaaactcataaaagctgaaagaaaattcattgaagatagagttaaaacaaataatagaactgaaaaggaaagtctgtagtaattcagataaaggatttgttattaatcaaaagggaattgaccccttttccttagatgctctttcaaagaaggcatagtcgctcttcacagagctaaaaggaggaatatggagaggctgactcttgcttgtggtggggtggccctgaattcttttgaggacctaagtcctgactgcttgagacatgcaggacttgtatatgagtatacattgggagaagttcacctttattgagaagtgtaacaaccctcgttctgtcacattattgatcaaaggaccaaataagcccacacttagatcaaagatgcagtaagggatggcttgagggctgtcaaaaatgctattgatgatggctgtgtggttccggtgctggtgccgtggaagtggcaatggcagaagccctgaataaatataagctcagtgtaaagggcaaggcacagcttggagtccaagcatttgctgatgtgttgctcgttattcccaaggtgagcccgtggtagcagcagaagcaggcattatgggataacgattgtgtaaagaaacagcttcttcattcctgcactggttgccaccaacattctcttggttgatgagatcatgcgagctggaatcttctctgaaaggttgaattgaagcttcctctgtatctgagtcttgaagactctgcaaagtgatcctgaagaatacagctgtggaatttttgtccaagcttcaaatgagctttcaagggaattttcccatgtgaaaaaaggagagaacactggcatctgttgaaattcggaagttctgaaattataattacagtattttttaaaaattgcactgaagtgtacacagataaagcaggtctttcacccagtgaacaggatgttttgctttagcagcagtgacataaaattccatgttaaataagcatatattacctaccttattaaatattccttgaaaaagcagattttaatggtttaattttatgtggacatatgttaaattattcagcagtaccctattgttaagcatctggttttaaaatttttatgctaatataaataacgcttagtaatttaaaattttggaagcatcccgttagtgtaaattctgagtaaatttattgatcagttggacttttcacgcttttgaaatagctttgctaaaatgctccccctacaaagttgtaggaaatgggaagaggagtaaact

SEQ ID NO: 361205 - DNA, 2125 bp, Homo sapiens
cgcgccgacttttccggaagatccggatagtgcatcccggccacggcgcgcctgctctgggctctccgcgtgccgcgtcgctttcttttcttcctctggagcagttatggcggcggcgaagaccctgaaccccaaggccaaggtggccggagcgcaggcggcgctggcgttcaacattagcggggcgcggggtctgcaggacgtgctgaggaccaacctggggcccaaagggaccataaagattcttgtttctggcgctggagacatcaagcttactaaagacacaggagttgacgatcagccctggccaacatggtgaaactcagtctctactaaaaatacaaaaattagccgggcacggtcctgcacagtgcgctgcttcacgaaatgcaaattcaacacccaacagcttccttaatagcaaaggtagcaacagcccaggatgatataactggtgatggtacgacttccaatgtcctaatcattggagagctgctgaaacaggcagatctctacatttctgaaggccttcatcccagaataatcactgaaggatttgaagctgtgaaggaaaagcccttcattttttggaagaagtcaaagtaagcagagagatggacaaggaaacacttaaagatgtggccagggcatctctttgtactaaagttcatgctgaacttgcagatgtcttaacagaggctgtagtgggctccattttggccattaaaagaaaagatgaacctattgatctcttcatgattttgtgatcattgacaagaaacataaatctgaaactgatacaagagaagtgaattctggcgttttttacaagagtgcagaaagagaaaaactcataaaagctgaaagaaaattcattgaagatagagttaaaacaaataatagaactgaaaaggaaagtctgtagtaattcagataaaggatttgttattaatcaaaagggaattgaccccttttccttagatgctctttcaaagaaggcatagtcgctcttcacagagctaaaaggaggaatatggagaggctgactcttgcttgtggtggggtggccctgaattcttttgaggacctaagtcctgactgcttgagacatgcaggacttgtatatgagtatacattgggagaagttcacctttattgagaagtgtaacaaccctcgttctgtcacattattgatcaaaggaccaaataagcccacacttagatcaaagatgcagtaagggatggcttgagggctgtcaaaaatgctattgatgatggctgtgtggttccggtgctggtgccgtggaagtggcaatggcagaagccctgaataaatataagctcagtgtaaagggcaaggcacagcttggagtccaagcatttgctgatgtgttgctcgttattcccaaggtgagcccgtggtagcagcagaagcaggcattatgggataacgattgtgtaaagaaacagcttcttcattcctgcactggttgccaccaacattctcttggttgatgagatcatgcgagctggaatcttctctgaaaggttgaattgaagcttcctctgtatctgagtcttgaagactctgcaaagtgatcctgaagaatacagctgtggaatttttgtccaagcttcaaatgagctttcaagggaattttcccatgtgaaaaaaggagagaacactggcatctgttgaaattcggaagttctgaaattataattacagtattttttaaaaattgcactgaagtgtacacagataaagcaggtctttcacccagtgaacaggatgttttgctttagcagcagtgacataaaattccatgttaaataagcatatattacctaccttattaaatattccttgaaaaagcagattttaatggtttaattttatgtggacatatgttaaattattcagcagtaccctattgttaagcatctggttttaaaatttttatgctaatataaataacgcttagtaatttaaaattttggaagcatcccgttagtgtaaattctgagtaaatttattgatcagttggacttttcacgcttttgaaatagctttgctaaaatgctccccctacaaagttgtaggaaatgggaagaggagtaaact

SEQ ID NO: 361206 - DNA, 377 bp, Homo sapiens
tgagacagagtctcgctctgtcacccaggctggagtgcagtggtgcaacctcggctcactgcaacctccacctcctgggttcaagcgattctcctgcctcagcctcccaagtagctaggactacaggcacccgccaccacgcccagctaatctttgtatttttagcagagacggggtttcaccatgttggccaggctagtctcgaactcctgacctcaaatgatccacccaccttggcctggccctgaggccatgaagccaaatacggccactagctgagcactggcttctatgcctcttaaaagtgtctgcaagcatgatagtcactccattttcctgtagatcatccaaaattctctatgaaacagtctttcctc

SEQ ID NO: 361207 - DNA, 2791 bp, Homo sapiens
agccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcggatctctgtgtcattgggcgcctgcctggggtctccatccctgacgttcccccactcccactccctctctctccctctctgcctcctcctgcctgtctgcactattcctttgcccggcatcaaggcacaggggaccagtggggaacactactgtagttagatctatttattgagcaccttgggcactgttgaagtgccttacattaatgaactcattcagtcaccatagcaacactctgagatggcagggactctgataacacccattttaaaggttgaggaaacaagcccagagaggttaagggaggagttcctgcccaccaggaacctgctttagtgggggatagtgaagaagacaataaaagatagtagttcaggccaggcggggtgctcacgcctgtaatcctagcacttttgggaggcagagatgggaggatacttgaatccaggcatttgagaccagcctgggtaacatagtgagaccctatctctacaaaacacttttaaaaaatgtacacctgtggtcccagctactctggaggctaaggtgggaggatcacttgatcctgggaggtcaaggctgcag

SEQ ID NO: 361208 - DNA, 2123 bp, Homo sapiens
agccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggaggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcg

SEQ ID NO: 361209 - DNA, 2344 bp, Homo sapiens
agccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacggtgaggcctgcttccccggccatgcccagttgtgacgtgtgtgcgtgtgtgtgttcccatctgccccacgccccacttatctatccctctgagagtgtgtgtgtatgtcccctatcccctgactcccacaccaaagcagggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcg

SEQ ID NO: 361210 - DNA, 1014 bp, Homo sapiens
ctaacccgcgtccctcaccctcacccgcgtgctaatggtggaaacccactacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcg

SEQ ID NO: 361211 - DNA, 1887 bp, Homo sapiens
agccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggaacccccgcgcgtgggttccttgcagacaggcataaaaattcctgggcaagaggcacttacccagcatccttacaaaggggttct

SEQ ID NO: 361212 - DNA, 1973 bp, Homo sapiens
agccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcg

SEQ ID NO: 361213 - DNA, 1837 bp, Homo sapiens
agccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtacgtctggcccaccgggctacgagatgcgcttggggggagccaggacggaggaagaggagagagaaagagaagtaaagtc

SEQ ID NO: 361214 - DNA, 790 bp, Homo sapiens
agccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagggagaagtgcgcctgggtgcgc

SEQ ID NO: 361215 - DNA, 444 bp, Homo sapiens
tccacccctcctctcatgggtactgttggggaggatgggtgccacaggaccacacaggtggctgtctgagagggtagtgcctgggaactttctggaagcctgtttggggaagcagatggggtgaaggattcagttagtgtatgtggggtcgtgacaccatctacccactgtctctctcctgccttcatcatcctctagaaatacagcaacaattcctggcgatacctcagcaaccggctgctggcacccagcgactcgccagagtggttatcttttgatgtcaccggagttgtgcggcagtggttgagccgtggaggtgaggattacttgtgtgtcccacccctgtttctccctggggtccaccccattgtttgtcctggggtcactttgcctaggacccctctccgccccatactggtgtgaaagtgctgagacctggctccc

SEQ ID NO: 361216 - DNA, 2205 bp, Homo sapiens
agccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcg

SEQ ID NO: 361217 - DNA, 2218 bp, Homo sapiens
  misc_feature (2079)..(2080): n is a, c, g, or t
  misc_feature (2082)..(2082): n is a, c, g, or t
agccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccttnntntattttcaatttattttaaatttttatttttttaatttttattcttaatattataatataatatataatttattcaattattttacttactatattatctatatttattttaattatatttacttattaaattcaa

SEQ ID NO: 361218 - DNA, 2169 bp, Homo sapiens
agccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaagctcaatgaacagaacctcatccaggaagtccccaacatctggcaacgtgaagttggctaggaggaaggaagtgccccaaagagaacaagaagaagaggaccctgcattgacgttcctctgggaagcactcatttcctacctttcatttctaagaccgcatgatctgggacatccttcccttcctcgtcggttcgctttattgttcggtcttttaggtcctcgtcagtgggacaaattacaatagctttgcgctggaagccttcaaa

SEQ ID NO: 361219 - DNA, 2057 bp, Homo sapiens
agccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcg

SEQ ID NO: 361220 - DNA, 2017 bp, Homo sapiens
agccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacggtgaggcctgcttccccggccatgcccagttgtgacgtgtgtgcgtgtgtgtgttcccatctgccccacgccccacttatctatccctctgagagtgtgtgtgtatgtcccctatcccctgactcccacaccaaagcagggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagccgccccgccccggcaggcccggccccaccccgccccgcccccgctgccttgcccatgggggctgtatttaaggacacccgtgccccaagcccacctggggccccattaaagatggagagaggactgcg

SEQ ID NO: 361221 - DNA, 1629 bp, Homo sapiens
agccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggagggaaattgagggcattcgccagagcggacatagctcatgtgccagcagggtcatcgcactgccagtgtgtagaatgcagcagtgctccgaagcactgtctcgcggg

SEQ ID NO: 361222 - DNA, 404 bp, Homo sapiens
ggcccctccttcaacatgtggggattacaattcgacatgagatttgggtgaggacacagagccaaaccatgtcatgcggccatggggagcagctgcttaagtggtatgggtttccttttggagtgaggaaagaagagtttgaaactagataggggtggtgattgttcagtgttgcagatgtactaaatgccactgacttgttcagtttaaattggccaattttatgttatctgaatttcacctcaataaaagaacacctagttcactcccaggagcaggggaaaggataaagcagccagggtcaccatgtaaaggcataagcatggctgtattctgctacattgtattataaaccttatttacagcaagagaaggcatgcctgctctggcctatataatctgca

SEQ ID NO: 361223 - DNA, 3094 bp, Homo sapiens
ttgttaggtaaggctcatcaattgatttgttaaatcacatactaataggtggataattgtgaaaaattgaggaataacaatatacaattcaatgcttttttctttggcttttatgtcaaagccctgttgcatattttctaagtccagatggctcctaaactgaaagttactgtgagatttagctgccgtttgcattttctaaaaacatgaacattcatttatagtcaagtattggggatttttaaacccttacaagatgaggctaaaagttatataacaaaatctgtagctaacttcatatagtattcttcatacatacacacacattgattggcagtgagagagaagggcagtaattgaccgatttagatattaattggtttgttacaatctgtgactctgagctaatcagaaccagaacatgtagttctgaagctgtgtttcagtctgctcattgtaccataattaggaagaactgctttggcaaatcatggaatttgggagcttatataaagggacttcattatcattattctataggaagaactgctttggcaaatcatggaatttgggagcttacgtaaggttacttcattatcattattctaacttatttttccaatgaagaagcagatctgtctggagaggttaagttgaactaaggttttatagaaagctggtggctaaggcagaactaaaggtaactttctaagacccaatctgatatccttgagtcttattgtaggcttttgcctttgttaagcatactccaactaataccccaactaattccaggcaaatggaagtttaatgcaaaagcgtcatggaatacagcagttttctaataatataatttgttatttagaatatacactgtcatgtcatgctatatgtaaaataattaggcaaccattaacaccattattacacagtttgttttgaaaatgtgttaatcctgcctccaacctaaattttgtcaaggggcttctatttctttttttggggggcaggtaatatttctcttggttatgatatgacataatatttaagaactacagattctgtttttcttggcattagtggtgattgggaggaatagaaaagaattacaagcataatattccagcacagttacgtgtgagatgtaaattaaaactgttctataaatttgtaagtttcaaacaagtataactgttaagcaaacacagcaggaaattgtaaactgtttcgtgcaagagggtgttttagggcatttttgccaaggttaggtttcaggctcatagacctactatgtataattatcacaatattttcaagtaaagtttacaagattctttaaatttgggaagtccaaaattaaagacttaattgttatttttttgagacagggtcttgctctgttgcccatgctggagtgcagtggtgtgatttcggcttactgcaacccccgcctcccaggttcaagtgagattcttgtgcttcatccacccaagtagctggattacaggcatgcaccaccatacctggctatttttgtatttttagtagagatggggttagaccatgttggccaggctggtcttgaactcctggcctcaggtggtacacccacctcggcctcccaaagtgttggattacaggcatgagccaccatgcccagccaatatattagaatttctataaatgctgtttgagaagtaacatctttactttctaagagtccaaaaattagcaaacaggtacatgttcaaaggtaaatgctaagaaattgggtaatccactctaacagagaacagagattgtatctattaatctatagaaggaattgcgtaactcattattttgggaataatgcttgtctttacatggattatgtctatcaatctgtagaaggaattgcataattcattattttaggaataatgcttgtctttacatggggcaagtaagaggttaattattagtgtggattcttcttaaaaggaaattagaaattatctacatgacaacatatcctccctaccagtgactaaaggaggcagaataggagtatctatgcaagcttttaacactgacattgtcccaaagtaaaattagcagataaaatcatatatgacagctgttagtataatttttgcttttgctattgttttataatttgacaactttttaaaactttagaattcctaatgtcttgtcttaaaagtttttcaggctgggcatggtggctcaagcctgtaatctcaacatgtttagaccaagacaggaggattgcttgaggccaggaatttgaaattgtcctgggcaccgtagcgagactctgctttctacaaaaataattaaaaaaaaaaaaaaattgccaggtatggtgatgtgcacctgtagtcctaactactctaagcctgaggcaagagaattgtttgatcccaggggttcaaggttgcagtgagctgtgattgtgggccactgcactccagcctgggtgacagagcaaaaccctatctcaaagaaaacaaagaaaaaaggaaaaaagaaaacctttccagtgttctattatagacattttcattgatcaataagtcactttttctctagtgcaatggattcttatttttatgtgaatcatcaacaaaatcaatgcaaccaacttaggctgttctgtttaaataaattaagaaatgagggtgtgtgaagttctaaaattgtacagaactatgcttatataaaaagtttatttctactcctgtggtatttcagaaattcttaagattcctgaggatactactttctctaagtatcaaatgaccactagcctggaataataaatagtaagcaagacagtaaatactacagataaacaacattttcccaaagttaatccacattctaaattgggaaaagtgagtaatacattcaagaagcagatatatatattcttaaaatacgatgctttggcttactgttttcttaaagctttctgtgtctgggctttcttttattggtttagagtgaattttatgggttctatgagtactaaaaattctgtttatatatattgttttaatgtaacacattatataggtgttttctaaaa

SEQ ID NO: 361224 - DNA, 1442 bp, Homo sapiens
cgcgcggaccggggcggggcgggcggtgccccgggctgggcgaggggccgggtgcggggccgctggccgagaggctgaggcggcgtcatgtcctccgaggtgtccgcgcgccgcgacgccaagaagctggtgcgctccccgagcggcctgcgcatggtgcccgaacaccgcgccttcggaagcccgttcggcctggaggagccgcagtgggtcccggacaaggagtgtcggagatgtatgcagtgtgacgccaagtttgactttctcaccagaaagcaccactgtcgccgctgcgggaagtgcttctgcgacaggtgctgcagccagaaggtgccgctgcggcgcatgtgctttgtggaccccgtgcggcagtgcgcggagtgcgccctggtgtccctcaaggaggcggagttctacgacaagcagctcaaagtgctcctgagcggagccaccttcctcgtcacgtttggaaactcagagaaacctgaaactatgacttgtcgtctttccaataaccagagatacttgtttctggatggagacagccactatgaaatcgaaattgtacacatttccaccgtgcagatcctcacagaaggcttccctcctggaggaggcaacgcacgggccacaggcatgttcctgcagtatacagtgccggggacggagggtgtgacccagctgaagctgacagtggtggaggacgtgactgtgggcaggaggcaggcggtggcgtggctagtggccatgcacaaggctgccaagctcctctatgaatctcgggaccagtaactctacgtggggctgagcttggagtacgtgtggtcaccaggactgagtcgcttggaacagcagagcctgctccttgcgtaccacagggattaatcctgcttgtgctgggaaatgcaactcactcatgtatttggagaaacaggagtgttcacttatctagtgcaatatgttcacagtttattaatgctttaaacagcttcatgttttagaatttgtgtattgtcaatacttaattgggggtgggagagactgagctacactactgctaaactatttttagcataatatataccatttttatgagttcgcaggtctactagaaggttctggcccatcaatattcatttcatttaattcttccacagaaccagtttgggcagtaggaactcaggcttctggtctgcagtggagcctgttcgcctctaatagccagtttacagcacttgccttagcctgtttcacagacttgtccacttaccttgtcactaatttggggcttctgggctgtgagtgatcctttgatacttcaccaaggggaacgtgggggctttgtgttttgtacttttcactcactatttcactttattaagatgactgtacagcaatttgtatataaagcttatgattaaaaactattttgaacatacgga

SEQ ID NO: 361225 - DNA, 2018 bp, Homo sapiens
ctctactaacaatacaaaaaaaaaaaaaaatagctgggcgtagaggtacacgcctgtaatcccagctactcaggaggctgaggcaggagaatcacttgaacccgggaggcggagggtgcagagccgagatcgcaccactgctctctagcctgggcaacaagagcaaagactccgtctcggaaaaaaaaaatgtggttccggggcctcccaggggacagcgtgtcataggttgctcaggcctccaagcacggtcggtgggcctccgactgcagccttggtgcccactccaccaaccggcagaagagccggccctgagtgctgatggggggatgtgtgtctgatggaggggtctcctgagaggtcagtgattgcctacgatggggcttccctcccaagtcatcaagttcatgggaggctgcatcccatgggtctctttcaacaccagccctgactgaagagctgctctcttcagcagtgtattgttggagcgagtgctggaattgagtcattgtcactggaacagctggtcaccgcccaaagacggggagcctgggtcccagagaccagtccccaacatgggtgctgggtctggggagatggcccgtgaccaggctggggtggcatttccctgacactgggcctttgtagtgacaatcccctctgtgctgacgccgcttctcaacggtgggatggctgaggcctctgactcctgggtgaggccagctgtgtccctgaccatctgcttggcctgtcagtggccagggcactctcgaggtggcctccactcttcccccagccctgggtgcaggtgggcacctctgcaggagccagtcttgtctggaggttctctgaaggcaggaacccccacaggccccagggcatagcagcgcctcaattagccgagagcaaggcctctcgtggtgatgtggctcttgttgtttgtcccgggccctggggcacccggctgagtgtcttggtccctctcccaccccacctgtgagcttggggtctcccctcagaggcctgaggagatggtgttccctgggtgctcctgagcaccagccctcactgccaggctactcttggagcagcacaaggttaggatgtgctggccaccgccttggggctggtggccgcctgggcactcagggcctcctttgggccgtcttacctcgtctctctcctccaggaggcaacgcacgggccacaggcatgttcctgcagtatacagtgccggggacggagggtgtgacccagctgaagctgacagtggtggaggacgtgactgtgggcaggaggcaggcggtggcgtggctagtggccatgcacaaggctgccaagctcctctatgaatctcgggaccagtaactctacgtggggctgagcttggagtacgtgtggtcaccaggactgagtcgcttggaacagcagagcctgctccttgcgtaccacagggattaatcctgcttgtgctgggaaatgcaactcactcatgtatttggagaaacaggagtgttcacttatctagtgcaatatgttcacagtttattaatgctttaaacagcttcatgttttagaatttgtgtattgtcaatacttaattgggggtgggagagactgagctacactactgctaaactatttttagcataatatataccatttttatgagttcgcaggtctactagaaggttctggcccatcaatattcatttcatttaattcttccacagaaccagtttgggcagtaggaactcaggcttctggtctgcagtggagcctgttcgcctctaatagccagtttacagcacttgccttagcctgtttcacagacttgtccacttaccttgtcactaatttggggcttctgggctgtgagtgatcctttgatacttcaccaaggggaacgtgggggctttgtgttttgtacttttcactcactatttcactttattaagatgactgtacagcaatttgtatataaagcttatgattaaaaactattttgaacatacgga

SEQ ID NO: 361226 - DNA, 630 bp, Homo sapiens
gacatttgcctcagcatgtcataatgatttcctctgctctaaatgctctaacgtatcattcggtttattgttggattcaaaccaaggataaagccccaaatgcaataactgagatccccaaaaaggtctgaatggtggctcatcgggagccagcacttcagccctcctcctgcaggcgtctgtgcagactaaacccctggtgcatttcctggtgagctttggcccatcctgggcctctccactaaactctgctgacggggagctcgcatcccgttatctgcaaactgtgctgacagatgcgtgtgccgtaacccatgttgctttccttccgttctctcaccggctcttggttgctccttctcgccactgcctgcccaccttcttgccatagaaaaagacattcacgcttacaccagcctccgggggagccagcctgcctctgaaggtcagcctcttcctcctcaccggggctccccgcatgcagcgggcccgttcctcccctcgccacctggcttctgtccacggggtggtccatgccaaggttctttgtgaaacctgaattcacttactttggttgacttaagagagatgttggatctgataagtgggtttataaagcataaatgaaga

SEQ ID NO: 361227 - DNA, 1629 bp, Homo sapiens
cgcgcggaccggggcggggcgggcggtgccccgggctgggcgaggggccgggtgcggggccgctggccgagaggctgaggcggcgtcatgtcctccgaggtgtccgcgcgccgcgacgccaagaagctggtgcgctccccgagcggcctgcgcatggtgcccgaacaccgcgccttcggaagcccgttcggcctggaggagccgcagtgggtcccggacaaggagtgtcggagatgtatgcagtgtgacgccaagtttgactttctcaccagaaaggtgaggcggatccccgctgcgtggtggggagcccaggggctggcgacaggaggtgcgcgtgtgcagcggccggcacaggggcctcgcgtttaggcgtggcccggggagtgccaggccagccggggccacacccggggccgcttgttccctgcccctcctcactgccaatcctcccgcatctgcccagcaccactgtcgccgctgcgggaagtgcttctgcgacaggtgctgcagccagaaggtgccgctgcggcgcatgtgctttgtggaccccgtgcggcagtgcgcggagtgcgccctggtgtccctcaaggaggcggagttctacgacaagcagctcaaagtgctcctgagcggagccaccttcctcgtcacgtttggaaactcagagaaacctgaaactatgacttgtcgtctttccaataaccagagatacttgtttctggatggagacagccactatgaaatcgaaattgtacacatttccaccgtgcagatcctcacagaaggcttccctcctggaggaggcaacgcacgggccacaggcatgttcctgcagtatacagtgccggggacggagggtgtgacccagctgaagctgacagtggtggaggacgtgactgtgggcaggaggcaggcggtggcgtggctagtggccatgcacaaggctgccaagctcctctatgaatctcgggaccagtaactctacgtggggctgagcttggagtacgtgtggtcaccaggactgagtcgcttggaacagcagagcctgctccttgcgtaccacagggattaatcctgcttgtgctgggaaatgcaactcactcatgtatttggagaaacaggagtgttcacttatctagtgcaatatgttcacagtttattaatgctttaaacagcttcatgttttagaatttgtgtattgtcaatacttaattgggggtgggagagactgagctacactactgctaaactatttttagcataatatataccatttttatgagttcgcaggtctactagaaggttctggcccatcaatattcatttcatttaattcttccacagaaccagtttgggcagtaggaactcaggcttctggtctgcagtggagcctgttcgcctctaatagccagtttacagcacttgccttagcctgtttcacagacttgtccacttaccttgtcactaatttggggcttctgggctgtgagtgatcctttgatacttcaccaaggggaacgtgggggctttgtgttttgtacttttcactcactatttcactttattaagatgactgtacagcaatttgtatataaagcttatgattaaaaactattttgaacatacgga

SEQ ID NO: 361228 - DNA, 1775 bp, Homo sapiens
cgcgcggaccggggcggggcgggcggtgccccgggctgggcgaggggccgggtgcggggccgctggccgagaggctgaggcggcgtcatgtcctccgaggtgtccgcgcgccgcgacgccaagaagctggtgcgctccccgagcggcctgcgcatggtgcccgaacaccgcgccttcggaagcccgttcggcctggaggagccgcagtgggtcccggacaaggagtgtcggagatgtatgcagtgtgacgccaagtttgactttctcaccagaaagcaccactgtcgccgctgcgggaagtgcttctgcgacaggtgctgcagccagaaggtgccgctgcggcgcatgtgctttgtggaccccgtgcggcagtgcgcggagtgcgccctggtgtccctcaaggaggcggagttctacgacaagcagctcaaagtgctcctgagcggagccaccttcctcgtcacgtttggaaactcagagaaacctgaaactatgacttgtcgtctttccaataaccagagatacttgtttctggatggagacagccactatgaaatcgaaattgtacacatttccaccgtgcagatcctcacagaaggcttccctcctggaggaggcaacgcacgggccacaggcatgttcctgcagtatacagtgccggggacggagggtgtgacccagctgaagctgacagtggtggaggacgtgactgtgggcaggaggcaggcggtggcgtggctagtggccatgcacaaggctgccaagctcctctatgaatctcgggaccagtaactctacgtggggctgagcttggagtacgtgtggtcaccaggactgagtcgcttggaacagcagagcctgctccttgcgtaccacagggattaatcctgcttgtgctgggaaatgcaactcactcatgtatttggagaaacaggagtgttcacttatctagtgcaatatgttcacagtttattaatgctttaaacagcttcatgttttagaatttgtgtattgtcaatacttaattgggggtgggagagactgagctacactactgctaaactatttttagcataatatataccatttttatgagttcgcaggtctactagaaggttctggcccatcaatattcatttcatttaattcttccacagaaccagtttgggcagtaggaactcaggcttctggtctgcagtggagcctgttcgcctctaatagccagtttacagcacttgccttagcctgtttcacagacttgtccacttaccttgtcactaatttggggcttctgggctgtgagtgatcctttgatacttcaccaaggggaacgtgggggctttgtgttttgtacttttcactcactatttcactttattaagatgactgtacagcaatttgtatataaagcttatgattaaaaactattttgaacatacggacaaggcctcgccttcctgtgtccagatcacctgaaccctcgtgccacagcgcagtctgggtccagaaagaagactcacagccgccggggtgagacgggtttattgtgcacatttacacagcgtcagcagcgtctgggctggcagcggccatgctcctgtggtcgggctgctctacaagggcgttcacttttcttcaccacactatgtacagtcagtgctccaaggtgatgggctacagtgctgcatcagtgagtctgtacacacatttttacataaattacacacgactcatacatgaaaaatagagcctaagggcctgtattttaatgagaa

SEQ ID NO: 361229 - DNA, 1496 bp, Homo sapiens
cgcgcggaccggggcggggcgggcggtgccccgggctgggcgaggggccgggtgcggggccgctggccgagaggctgaggcggcgtcatgtcctccgaggtgtccgcgcgccgcgacgccaagaagctggtgcgctccccgagcggcctgcgcatggtgcccgaacaccgcgccttcggaagcccgttcggcctggaggagccgcagtgggtcccggacaaggagtgtcggagatgtatgcagtgtgacgccaagtttgactttctcaccagaaagcaccactgtcgccgctgcgggaagtgcttctgcgacaggtgctgcagccagaaggtgccgctgcggcgcatgtgctttgtggaccccgtgcggcagtgcgcggagtgcgccctggtgtccctcaaggaggcggagttctacgacaagcagctcaaagtgctcctgagcggagccaccttcctcgtcacgtttggaaactcagagaaacctgaaactatgacttgtcgtctttccaataaccagagatacttgtttctggatggagacagccactatgaaatcgaaattgtacacatttccaccgtgcagatcctcacagaaggcttccctcctggagaaaaagacattcacgcttacaccagcctccgggggagccagcctgcctctgaaggaggcaacgcacgggccacaggcatgttcctgcagtatacagtgccggggacggagggtgtgacccagctgaagctgacagtggtggaggacgtgactgtgggcaggaggcaggcggtggcgtggctagtggccatgcacaaggctgccaagctcctctatgaatctcgggaccagtaactctacgtggggctgagcttggagtacgtgtggtcaccaggactgagtcgcttggaacagcagagcctgctccttgcgtaccacagggattaatcctgcttgtgctgggaaatgcaactcactcatgtatttggagaaacaggagtgttcacttatctagtgcaatatgttcacagtttattaatgctttaaacagcttcatgttttagaatttgtgtattgtcaatacttaattgggggtgggagagactgagctacactactgctaaactatttttagcataatatataccatttttatgagttcgcaggtctactagaaggttctggcccatcaatattcatttcatttaattcttccacagaaccagtttgggcagtaggaactcaggcttctggtctgcagtggagcctgttcgcctctaatagccagtttacagcacttgccttagcctgtttcacagacttgtccacttaccttgtcactaatttggggcttctgggctgtgagtgatcctttgatacttcaccaaggggaacgtgggggctttgtgttttgtacttttcactcactatttcactttattaagatgactgtacagcaatttgtatataaagcttatgattaaaaactattttgaacatacgga

SEQ ID NO: 361230 - DNA, 1222 bp, Homo sapiens
cgcgcggaccggggcggggcgggcggtgccccgggctgggcgaggggccgggtgcggggccgctggccgagaggctgaggcggcgtcatgtcctccgaggtgtccgcgcgccgcgacgccaagaagctggtgcgctccccgagcggcctgcgcatggtgcccgaacaccgcgccttcggaagcccgttcggcctggaggagccgcagtgggtcccggacaaggaggagccaccttcctcgtcacgtttggaaactcagagaaacctgaaactatgacttgtcgtctttccaataaccagagatacttgtttctggatggagacagccactatgaaatcgaaattgtacacatttccaccgtgcagatcctcacagaaggcttccctcctggaggaggcaacgcacgggccacaggcatgttcctgcagtatacagtgccggggacggagggtgtgacccagctgaagctgacagtggtggaggacgtgactgtgggcaggaggcaggcggtggcgtggctagtggccatgcacaaggctgccaagctcctctatgaatctcgggaccagtaactctacgtggggctgagcttggagtacgtgtggtcaccaggactgagtcgcttggaacagcagagcctgctccttgcgtaccacagggattaatcctgcttgtgctgggaaatgcaactcactcatgtatttggagaaacaggagtgttcacttatctagtgcaatatgttcacagtttattaatgctttaaacagcttcatgttttagaatttgtgtattgtcaatacttaattgggggtgggagagactgagctacactactgctaaactatttttagcataatatataccatttttatgagttcgcaggtctactagaaggttctggcccatcaatattcatttcatttaattcttccacagaaccagtttgggcagtaggaactcaggcttctggtctgcagtggagcctgttcgcctctaatagccagtttacagcacttgccttagcctgtttcacagacttgtccacttaccttgtcactaatttggggcttctgggctgtgagtgatcctttgatacttcaccaaggggaacgtgggggctttgtgttttgtacttttcactcactatttcactttattaagatgactgtacagcaatttgtatataaagcttatgattaaaaactattttgaacatacgga

SEQ ID NO: 361231 - DNA, 1110 bp, Homo sapiens
gtttctcctgggccttgaaaggaattgaaggatttaaatgtttgaatgtggtggtaagatggctactgtaggtggaagatgactcaccctttaccttgaaaggatgaaggagaaaccctgattgaggtctaagaaaaaacaatcatgacctgcggaaggctttggccagagctgtagagtgcatgagggtgagaacggggagatcccgtgaaaaggtaatacatcggctttcatatgttttaggcatgagatgagctgaatcctgatatgatttgagttagtcttcccatgacctgatggaagagctgttatctccatttaagaaaagtgaagctgcccaggtgtggtggctcacatctgtaatcccagcactgtgggaggctgaggcaggaggatcacttgagcttgggagtttgaggccagcctgggtaacatagcgagaccccatctcaataaaatagaataaaaaaaagaaaaaaaaatgaagctgagagtttatttagccagggtcacacagctggaaagtagctagtgtggaccttggcctgagatgtgatctgtctagctatgatacaacactgcttcacagataaagtaccagcttcaggaattggaagttattgatttttcttggataacatgggcacatttcagtcatatttgaattttaatttagttggattctcacttatttgtaaagctaaccggtttgtattggaaatattataaatattctgggaatctcaaatgttgattttatactagctttttagttatttaagataaatttacattttattctattaacatctctttgaaaagacgtagtgcttttttaggttgtctatttatgtgtgtatgtgagacatttcctcttgggggattctctgagactcacatttctgtagaagcttttttcagatatacttatgaaaatctgttctctgttttgagaaatcttgaaagctatgatatgttgcaactagacactctagcttcattgattggaggctaagggttcccgtatttgtgggcagtaacaacaaaattgacaatttattttgtgtaaagtatttcaaatgtcagttatttctagaggttttttttctt

SEQ ID NO: 361232 - DNA, 226 bp, Homo sapiens
gagtgagttttgatgctataatcctggatcttctacttcctagcattggaaacttgggcaaccgaactctgtgccattttattatgtgaaatgggtatttttttattaaatagttatgccacagagattttttgtgaagattaaatgtttagtatatatacagtccaaaaacctgtaattggcacatggtaaatagttaataaacatgcatcgttgttattgttaa

SEQ ID NO: 361233 - DNA, 620 bp, Homo sapiens
accaatgatttacggaatttcggagcttcggtacgccctttggacgtaagacgcatggtacagtagtcctcatcacaaccatgccacactggtgagccaccagctacctccagggttactctgaggacccaatgagcaaatacttataaaagcactttgaaaactgccttatcaatgtaagtggttgggtctacaaacatacccaattcctctagtgggatttgatctacaaaaatcaagagataagcacattttttttctgagatatgttattgacattaagccacctctcctgtctaacttaatggatggataatgctttatcagttgggacctacatgtgtgatttcctcatgcattgtcaattccaataaggatatatcatcatgaatggtttctttaggatccagttttattgctgacatcctcagtaacagccaaaaggtcgttttcagagatctaagctggagcatgatggtcaaggatacccctaaggactgtgtgcacatcattattaatggacttttcccaccatgttatttattggttgatgtatctgtcactcccagctgggacacaggggccttaaggagagagaatctcctgccccaggcctggca

SEQ ID NO: 361234 - DNA, 399 bp, Homo sapiens
ttgagagtgagtctcccattgtcctgtgcctctcctggcccaggtgtgttaccgggtactgatgcagctctgctcacactatgggcagcctgtgctgtctgtgcgggtcatgctggagatgcgtcaggcaggcattgtgcccaacaccatcacctatggctactacaataaggtacctactttggggtgaggggtgggatggcagctgtgccagggtgtgtgaggggaggctgctgctgctcccctcgctccttggagattgggctggtactgtttgcctaggtcctggaaccactgtcatccacattgcactcctgtggtgccttagcacctacagtttctcagacgaggctgctttgattcccactcatgacagccctgcctacaactaatagtgtc

SEQ ID NO: 361235 - DNA, 5909 bp, Homo sapiens
cgccggccgaggaggaggggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacaggcagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcaggtgagtggcccctttatccctccaatcctgtgaccctacatccctttgccctggtgcctcttggcaggcaccttaagtgtccccagagtttactttctctttgctactcgggccttctctgggatcccttggttcatttcccttggagtctgatggaccctgctccttttgggtacccccaactatgctgggggtgcagagctgctgggccgctacccggaggaggacaatgaggcgttcccgctgcccgagtcagtgcccgtcttctgcctgcccatgggggccactatcgagtgctggcctgcccagaccaagtaccccgtgcccgtcttctccacctttgtgctcacgggtgcagctggtgataaggtgtatggtgccgccctgcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgccttcctcaccttcctttaccgctactccgtctcaggcccccaccgcctacccttggaagcgcacatctcccacttcattcacaacgttcccttcccttccccacagagaccccgcatcctagtgcagatgtctccctatgacaacttgctcctctgtcagcctgtatcctcacccctgcccctcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcgatgatcttcccactgcactggcagtgcccctacattcctctgtgcccgctggtgctggcagatgtgctgagtgccccagtgcccttcattgtgggtatccactccagctactttgatctgcatgacccgcctgctgatgtcatctgtgtagaccttgataccaacacgctcttccagactgaggaaaagaagctcctctcccctcggaccctgccccgcagaccctacaaggttctgctggccacactgacaaacctgtaccagcagctggaccagacatacactggacctgaggaggaagcatccctggagttcctactgacagactacgaggcagtgtgtggccgcagggcccggctggagcgcgaagtccaaggagccttcctccgcttcatggcctgtctgctcaagggctaccgggtcttcctgcgcccactcacccaggccccctccgagggagctcgtgatgttgacaaccttttcttcctgcagggcttcctcaaatcccgggaacgctccagccacaaactttactctcagctgctgcacacacagatgttctcacagttcattgaggagtgctcttttggctctgctcgccatgctgcccttgaattctttgactcttgtgttgaaaaggtccacccagagcaggagaagcctgagccgacacccttagtggagctagaggagctgtcaggaagtgagctcactgtctttatcacacctcccgaggagcctgccttaccagagggcagtgaatccactccccagtactgctatgatggattcccagagctacgggctgagttgtttgagtctcttcaagagcaacctggggccctgcctgtgccaggcccttcccgtagcgcccccagcagtcctgctcctcgccgtaccaaacaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtgtgttaccgggtactgatgcagctctgctcacactatgggcagcctgtgctgtctgtgcgggtcatgctggagatgcgtcaggcaggcattgtgcccaacaccatcacctatggctactacaataaggctgtgttggaaagcaagtggccgtctggcacaccaggtgggcgtctgcgctgggccaagctccggaatgttgtcctgggggctgctcagttccgccagcccttgagagaacggcaacagcagcagcagcagcagcaacagcagcagcagcagcagcagcagcaggagcaggtgtcagcacatcaagaggcaggcagctcccaggcagagccctatttggagcgcccttcccctactcgccctcttcagcgccagactacttgggctgggcgaagtctgagagacccagcctcaccccctggacgcctggtgaagagtggtagcctgggcagtgcccgaggggcacagcccactgtggaggccggtgtggcccacatgatagaggccttgggggtcctggaaccccggggatcacctgtgccctggcacgatggaagtctctcagacctgagcctgacaggggaggagccgctccctggaggcagcccagggggctcaggctcagccctgagtgcccagtccactgaggccctggaagggctaagtgggcggggacccaaggctggtgggcgacaggatgaggcaggcaccccccgacgagggctgggtgcccgcctccaacagctgctcactccttcccgccactcccctgcctcccgcattcccccacctgagctgcctcctgacctgccacccccagcccgccgcagccccatggacagtcttctgcacccccgggagcgccctggatccactgcctccgagagctcagcctctctgggcagtgagtgggacctctcagaatcttctctcagcaacctgagtcttcgccgttcctcagagcgcctcagtgacacccctggatccttccagtcaccttccctggaaattctgctgtccagctgctccctgtgccgtgcctgtgattcgctggtgtatgatgaggaaatcatggctggctgggcacctgatgactctaacctcaacacaacctgccccttctgcgcctgcccctttgtgcccctgctcagtgtccagacccttgattcccggcccagtgtccccagccccaaatctgctggtgccagtggcagcaaagatgctcctgtccctggtggtcctggccctgtgctcagtgaccgaaggctctgccttgctctggatgagccccagctctgcaacgggcacatggggggagcctcccggcgggttgagagtggggcatgggcatacctgagccccctggtgctgcgtaaggagctggagtcgctggtagagaacgagggcagtgaggtgctggcgttgcctgaactgccctctgcccaccccatcatcttctggaaccttttgtggtatttccaacggctacgcctgcccagtattctaccaggcctggtgctggcctcctgtgatgggccttcgcactcccaggccccatctccttggctaacccctgatccagcctctgttcaggtacggctgctgtgggatgtactgacccctgaccccaatagctgcccacctctctatgtgctctggagggtccacagccagatcccccagcgggtggtatggccaggccctgtacctgcatcccttagtttggcactgttggagtcagtgctgcgccatgttggactcaatgaagtgcacaaggctgtggggctcctgctggaaactctagggcccccacccactggcctgcacctgcagaggggaatctaccgtgagatattattcctgacaatggctgctctgggcaaggaccacgtggacatagtggccttcgataagaagtacaagtctgcctttaacaagctggccagcagcatgggcaaggaggagctgaggcaccggcgggcgcagatgcccactcccaaggccattgactgccgaaaatgttttggagcacctccagaatgctagagaccttaagcttccctctccagcctagggtggggaagtgaggaagaagggattctagagttaaactgcttccctgttgccttcatggagttgggaacaggctgggaaggatgcccagtcaaaggctccaagcgaggacaacaggaagagggatccactgttaccaaaagtcctgattcccccatcaccaacctacccagtttgttcgtgctgatgttgggggagatctggggggagttggtacagctctgttcttcccttgtcctataccgggaactcccctccagggtacccacagatctgcattgccctggtcattttagaagtttttgttttaaaaaacaactggaaagatgcagagctactgagcctttgccctgaatgggaggtagggatgtcattctccaccaataatggtccctcttccctgacgttgctgaaggagcccaaggctctccatgcctttctacctaagtgtttgtattttattttaaattatttattctggagccacagcccccttgcttatgaggttcttatggagagtgagaaagggaagggaaatagggcaccatggtccggtggtttgtagttccttcaaagtcaggcactgggagctagaggagtctcaagctccccttaggaagaactggtgccccctccagtcctaatttttcttgcctgccccgccttggggaatgcctcacccacccaggtcctgacctgtgcaataaggattgttccctgcgaagttttgttggatgtaaatatagtaaaagctgcttctgtcttt

SEQ ID NO: 361236 - DNA, 6190 bp, Homo sapiens
cgccggccgaggaggaggggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacaggcagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcagagctgctgggccgctacccggaggaggacaatgaggcgttcccgctgcccgagtcagtgcccgtcttctgcctgcccatgggggccactatcgagtgctggcctgcccagaccaagtaccccgtgcccgtcttctccacctttgtgctcacgggtgcagctggtgataaggtgtatggtgccgccctgcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgccttcctcaccttcctttaccgctactccgtctcaggcccccaccgcctacccttggaagcgcacatctcccacttcattcacaacgttcccttcccttccccacagagaccccgcatcctagtgcagatgtctccctatgacaacttgctcctctgtcagcctgtatcctcacccctgcccctcaggtatgtgatcagattgtggggaggggagcctttaatgaccaaggacatggtaggtgctgggcaggtgggtgcagctgttgaggtttatgcaggctgggtccaggtggtggctgtgcctggcatctggggaagggtccccagggtatcctggtgaccctttccccacctcggcattgcctgcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcggtgagtgccgccccgcctggcccatcttccccagaaccatggttctttctggtgcccctatccctgcctggactcttcccttttccttccttgtggaggatcctcagcccctttccctgggcacagcctgcaggaacacatagcttccatcaggagctcttctctagagcctacttccaacagcctctctcaacaggcaccaactccccaaggccaatgccctctctttctctctcctgtgcctcccactgctgcctcaaccccctgttcactggttctcactgcctggtgcttcagatgatcttcccactgcactggcagtgcccctacattcctctgtgcccgctggtgctggcagatgtgctgagtgccccagtgcccttcattgtgggtatccactccagctactttgatctgcatgacccgcctgctgatgtcatctgtgtagaccttgataccaacacgctcttccagactgaggaaaagaagctcctctcccctcggaccctgccccgcagaccctacaaggttctgctggccacactgacaaacctgtaccagcagctggaccagacatacactggacctgaggaggaagcatccctggagttcctactgacagactacgaggcagtgtgtggccgcagggcccggctggagcgcgaagtccaaggagccttcctccgcttcatggcctgtctgctcaagggctaccgggtcttcctgcgcccactcacccaggccccctccgagggagctcgtgatgttgacaaccttttcttcctgcagggcttcctcaaatcccgggaacgctccagccacaaactttactctcagctgctgcacacacagatgttctcacagttcattgaggagtgctcttttggctctgctcgccatgctgcccttgaattctttgactcttgtgttgaaaaggtccacccagagcaggagaagcctgagccgacacccttagtggagctagaggagctgtcaggaagtgagctcactgtctttatcacacctcccgaggagcctgccttaccagagggcagtgaatccactccccagtactgctatgatggattcccagagctacgggctgagttgtttgagtctcttcaagagcaacctggggccctgcctgtgccaggcccttcccgtagcgcccccagcagtcctgctcctcgccgtaccaaacaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtgtgttaccgggtactgatgcagctctgctcacactatgggcagcctgtgctgtctgtgcgggtcatgctggagatgcgtcaggcaggcattgtgcccaacaccatcacctatggctactacaataaggctgtgttggaaagcaagtggccgtctggcacaccaggtgggcgtctgcgctgggccaagctccggaatgttgtcctgggggctgctcagttccgccagcccttgagagaacggcaacagcagcagcagcagcagcaacagcagcagcagcagcagcagcagcaggagcaggtgtcagcacatcaagaggcaggcagctcccaggcagagccctatttggagcgcccttcccctactcgccctcttcagcgccagactacttgggctgggcgaagtctgagagacccagcctcaccccctggacgcctggtgaagagtggtagcctgggcagtgcccgaggggcacagcccactgtggaggccggtgtggcccacatgatagaggccttgggggtcctggaaccccggggatcacctgtgccctggcacgatggaagtctctcagacctgagcctgacaggggaggagccgctccctggaggcagcccagggggctcaggctcagccctgagtgcccagtccactgaggccctggaagggctaagtgggcggggacccaaggctggtgggcgacaggatgaggcaggcaccccccgacgagggctgggtgcccgcctccaacagctgctcactccttcccgccactcccctgcctcccgcattcccccacctgagctgcctcctgacctgccacccccagcccgccgcagccccatggacagtcttctgcacccccgggagcgccctggatccactgcctccgagagctcagcctctctgggcagtgagtgggacctctcagaatcttctctcagcaacctgagtcttcgccgttcctcagagcgcctcagtgacacccctggatccttccagtcaccttccctggaaattctgctgtccagctgctccctgtgccgtgcctgtgattcgctggtgtatgatgaggaaatcatggctggctgggcacctgatgactctaacctcaacacaacctgccccttctgcgcctgcccctttgtgcccctgctcagtgtccagacccttgattcccggcccagtgtccccagccccaaatctgctggtgccagtggcagcaaagatgctcctgtccctggtggtcctggccctgtgctcagtgaccgaaggctctgccttgctctggatgagccccagctctgcaacgggcacatggggggagcctcccggcgggttgagagtggggcatgggcatacctgagccccctggtgctgcgtaaggagctggagtcgctggtagagaacgagggcagtgaggtgctggcgttgcctgaactgccctctgcccaccccatcatcttctggaaccttttgtggtatttccaacggctacgcctgcccagtattctaccaggcctggtgctggcctcctgtgatgggccttcgcactcccaggccccatctccttggctaacccctgatccagcctctgttcaggtacggctgctgtgggatgtactgacccctgaccccaatagctgcccacctctctatgtgctctggagggtccacagccagatcccccagcgggtggtatggccaggccctgtacctgcatcccttagtttggcactgttggagtcagtgctgcgccatgttggactcaatgaagtgcacaaggctgtggggctcctgctggaaactctagggcccccacccactggcctgcacctgcagaggggaatctaccgtgagatattattcctgacaatggctgctctgggcaaggaccacgtggacatagtggccttcgataagaagtacaagtctgcctttaacaagctggccagcagcatgggcaaggaggagctgaggcaccggcgggcgcagatgcccactcccaaggccattgactgccgaaaatgttttggagcacctccagaatgctagagaccttaagcttccctctccagcctagggtggggaagtgaggaagaagggattctagagttaaactgcttccctgttgccttcatggagttgggaacaggctgggaaggatgcccagtcaaaggctccaagcgaggacaacaggaagagggatccactgttaccaaaagtcctgattcccccatcaccaacctacccagtttgttcgtgctgatgttgggggagatctggggggagttggtacagctctgttcttcccttgtcctataccgggaactcccctccagggtacccacagatctgcattgccctggtcattttagaagtttttgttttaaaaaacaactggaaagatgcagagctactgagcctttgccctgaatgggaggtagggatgtcattctccaccaataatggtccctcttccctgacgttgctgaaggagcccaaggctctccatgcctttctacctaagtgtttgtattttattttaaattatttattctggagccacagcccccttgcttatgaggttcttatggagagtgagaaagggaagggaaatagggcaccatggtccggtggtttgtagttccttcaaagtcaggcactgggagctagaggagtctcaagctccccttaggaagaactggtgccccctccagtcctaatttttcttgcctgccccgccttggggaatgcctcacccacccaggtcctgacctgtgcaataaggattgttccctgcgaagttttgttggatgtaaatatagtaaaagctgcttctgtcttt

SEQ ID NO: 361237 - DNA, 3983 bp, Homo sapiens
ctcctcaatgaactgtgagaacatctgtgtgtgcagcagctgagagtaaagtttgtggctggagcgttcccgggaactgagggagattccaattccaactgaagctagaaggaagggcagacagtattcctgaacatgtgggaaatatcaagcttgaacctgttagttgaaggtaatactttagttgctactggtgcaaggtctgccagaggctggaggtggagatggaggcatgagagcagagttgagggtaacactatgggagccagccctgactcttaggctgccctggcctccagcatacactggacctgaggaggaagcatccctggagttcctactgacagactacgaggcagtgtgtggccgcagggcccggctggagcgcgaagtccaaggagccttcctccgcttcatggcctgtctgctcaagggctaccgggtcttcctgcgcccactcacccaggccccctccgagggagctcgtgatgttgacaaccttttcttcctgcagggcttcctcaaatcccgggaacgctccagccacaaactttactctcagctgctgcacacacagatgttctcacagttcattgaggagtgctcttttggctctgctcgccatgctgcccttgaattctttgactcttgtgttgaaaaggtccacccagagcaggagaagcctgagccgacacccttagtggagctagaggagctgtcaggaagtgagctcactgtctttatcacacctcccgaggagcctgccttaccagagggcagtgaatccactccccagtactgctatgatggattcccagagctacgggctgagttgtttgagtctcttcaagagcaacctggggccctgcctgtgccaggcccttcccgtagcgcccccagcagtcctgctcctcgccgtaccaaacaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtgtgttaccgggtactgatgcagctctgctcacactatgggcagcctgtgctgtctgtgcgggtcatgctggagatgcgtcaggcaggcattgtgcccaacaccatcacctatggctactacaataaggctgtgttggaaagcaagtggccgtctggcacaccaggtgggcgtctgcgctgggccaagctccggaatgttgtcctgggggctgctcagttccgccagcccttgagagaacggcaacagcagcagcagcagcagcaacagcagcagcagcagcagcagcagcaggagcaggtgtcagcacatcaagaggcaggcagctcccaggcagagccctatttggagcgcccttcccctactcgccctcttcagcgccagactacttgggctgggcgaagtctgagagacccagcctcaccccctggacgcctggtgaagagtggtagcctgggcagtgcccgaggggcacagcccactgtggaggccggtgtggcccacatgatagaggccttgggggtcctggaaccccggggatcacctgtgccctggcacgatggaagtctctcagacctgagcctgacaggggaggagccgctccctggaggcagcccagggggctcaggctcagccctgagtgcccagtccactgaggccctggaagggctaagtgggcggggacccaaggctggtgggcgacaggatgaggcaggcaccccccgacgagggctgggtgcccgcctccaacagctgctcactccttcccgccactcccctgcctcccgcattcccccacctgagctgcctcctgacctgccacccccagcccgccgcagccccatggacagtcttctgcacccccgggagcgccctggatccactgcctccgagagctcagcctctctgggcagtgagtgggacctctcagaatcttctctcagcaacctgagtcttcgccgttcctcagagcgcctcagtgacacccctggatccttccagtcaccttccctggaaattctgctgtccagctgctccctgtgccgtgcctgtgattcgctggtgtatgatgaggaaatcatggctggctgggcacctgatgactctaacctcaacacaacctgccccttctgcgcctgcccctttgtgcccctgctcagtgtccagacccttgattcccggcccagtgtccccagccccaaatctgctggtgccagtggcagcaaagatgctcctgtccctggtggtcctggccctgtgctcagtgaccgaaggctctgccttgctctggatgagccccagctctgcaacgggcacatggggggagcctcccggcgggttgagagtggggcatgggcatacctgagccccctggtgctgcgtaaggagctggagtcgctggtagagaacgagggcagtgaggtgctggcgttgcctgaactgccctctgcccaccccatcatcttctggaaccttttgtggtatttccaacggctacgcctgcccagtattctaccaggcctggtgctggcctcctgtgatgggccttcgcactcccaggccccatctccttggctaacccctgatccagcctctgttcaggtacggctgctgtgggatgtactgacccctgaccccaatagctgcccacctctctatgtgctctggagggtccacagccagatcccccagcgggtggtatggccaggccctgtacctgcatcccttagtttggcactgttggagtcagtgctgcgccatgttggactcaatgaagtgcacaaggctgtggggctcctgctggaaactctagggcccccacccactggcctgcacctgcagaggggaatctaccgtgagatattattcctgacaatggctgctctgggcaaggaccacgtggacatagtggccttcgataagaagtacaagtctgcctttaacaagctggccagcagcatgggcaaggaggagctgaggcaccggcgggcgcagatgcccactcccaaggccattgactgccgaaaatgttttggagcacctccagaatgctagagaccttaagcttccctctccagcctagggtggggaagtgaggaagaagggattctagagttaaactgcttccctgttgccttcatggagttgggaacaggctgggaaggatgcccagtcaaaggctccaagcgaggacaacaggaagagggatccactgttaccaaaagtcctgattcccccatcaccaacctacccagtttgttcgtgctgatgttgggggagatctggggggagttggtacagctctgttcttcccttgtcctataccgggaactcccctccagggtacccacagatctgcattgccctggtcattttagaagtttttgttttaaaaaacaactggaaagatgcagagctactgagcctttgccctgaatgggaggtagggatgtcattctccaccaataatggtccctcttccctgacgttgctgaaggagcccaaggctctccatgcctttctacctaagtgtttgtattttattttaaattatttattctggagccacagcccccttgcttatgaggttcttatggagagtgagaaagggaagggaaatagggcaccatggtccggtggtttgtagttccttcaaagtcaggcactgggagctagaggagtctcaagctccccttaggaagaactggtgccccctccagtcctaatttttcttgcctgccccgccttggggaatgcctcacccacccaggtcctgacctgtgcaataaggattgttccctgcgaagttttgttggatgtaaatatagtaaaagctgcttctgtcttt

SEQ ID NO: 361238 - DNA, 5998 bp, Homo sapiens
cgccggccgaggaggaggggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacaggcagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcaggtgagtggcccctttatccctccaatcctgtgaccctacatccctttgccctggtgcctcttggcaggcaccttaagtgtccccagagtttactttctctttgctactcgggccttctctgggatcccttggttcatttcccttggagtctgatggaccctgctccttttgggtacccccaactatgctgggggtgcagagctgctgggccgctacccggaggaggacaatgaggcgttcccgctgcccgagtcagtgcccgtcttctgcctgcccatgggggccactatcgagtgctggcctgcccagaccaagtaccccgtgcccgtcttctccacctttgtgctcacgggtgcagctggtgataaggtgtatggtgccgccctgcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgccttcctcaccttcctttaccgctactccgtctcaggcccccaccgcctacccttggaagcgcacatctcccacttcattcacaacgttcccttcccttccccacagagaccccgcatcctagtgcagatgtctccctatgacaacttgctcctctgtcagcctgtatcctcacccctgcccctcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcgatgatcttcccactgcactggcagtgcccctacattcctctgtgcccgctggtgctggcagatgtgctgagtgccccagtgcccttcattgtgggtatccactccagctactttgatctgcatgacccgcctgctgatgtcatctgtgtagaccttgataccaacacgctcttccagactgaggaaaagaagctcctctcccctcggaccctgccccgcagaccctacaaggttctgctggccacactgacaaacctgtaccagcagctggaccagacatacactggacctgaggaggaagcatccctggagttcctactgacagactacgaggcagtgtgtggccgcagggcccggctggagcgcgaagtccaaggagccttcctccgcttcatggcctgtctgctcaagggctaccgggtcttcctgcgcccactcacccaggccccctccgagggagctcgtgatgttgacaaccttttcttcctgcagggcttcctcaaatcccgggaacgctccagccacaaactttactctcagctgctgcacacacagatgttctcacagttcattgaggagtgctcttttggctctgctcgccatgctgcccttgaattctttgactcttgtgttgaaaaggtccacccagagcaggagaagcctgagccgacacccttagtggagctagaggagctgtcaggaagtgagctcactgtctttatcacacctcccgaggagcctgccttaccagagggcagtgaatccactccccagtactgctatgatggattcccagagctacgggctgagttgtttgagtctcttcaagagcaacctggggccctgcctgtgccaggcccttcccgtagcgcccccagcagtcctgctcctcgccgtaccaaacaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtgtgttaccgggtactgatgcagctctgctcacactatgggcagcctgtgctgtctgtgcgggtcatgctggagatgcgtcaggcaggcattgtgcccaacaccatcacctatggctactacaataaggctgtgttggaaagcaagtggccgtctggcacaccaggtgggcgtctgcgctgggccaagctccggaatgttgtcctgggggctgctcagttccgccagcccttgagagaacggcaacagcagcagcagcagcagcaacagcagcagcagcagcagcagcagcaggagcaggtgtcagcacatcaagaggcaggcagctcccaggcagagccctatttggagcgcccttcccctactcgccctcttcagcgccagactacttgggctgggcgaagtctgagagacccagcctcaccccctggacgcctggtgaagagtggtagcctgggcagtgcccgaggggcacagcccactgtggaggccggtgtggcccacatgatagaggccttgggggtcctggaaccccggggatcacctgtgccctggcacgatggaagtctctcagacctgagcctgacaggggaggagccgctccctggaggcagcccagggggctcaggctcagccctgagtgcccagtccactgaggccctggaagggctaagtgggcggggacccaaggctggtgggcgacaggatgaggcaggcaccccccgacgagggctgggtgcccgcctccaacagctgctcactccttcccgccactcccctgcctcccgcattcccccacctgagctgcctcctgacctgccacccccagcccgccgcagccccatggacagtcttctgcacccccgggagcgccctggatccactgcctccgagagctcagcctctctgggcagtgagtgggacctctcagaatcttctctcagcaacctgagtcttcgccgttcctcagagcgcctcagtgacacccctggatccttccagtcaccttccctggaaattctgctgtccagctgctccctgtgccgtgcctgtgattcgctggtgtatgatgaggaaatcatggctggctgggcacctgatgactctaacctcaacacaacctgccccttctgcgcctgcccctttgtgcccctgctcagtgtccagacccttgattcccggcccagtgtccccagccccaaatctgctggtgccagtggcagcaaagatgctcctgtccctggtggtcctggccctgtgctcagtgaccgaaggctctgccttgctctggatgagccccagctctgcaacgggcacatggggggagcctcccggcgggttgagagtggggcatgggcatacctgagccccctggtgctgcgtaaggagctggagtcgctggtagagaacgagggcagtgaggtgctggcgttgcctgaactgccctctgcccaccccatcatcttctggaaccttttgtggtatttccaacggctacgcctgcccagtattctaccaggcctggtgctggcctcctgtgatgggccttcgcactcccaggccccatctccttggctaacccctgatccagcctctgttcaggtacggctgctgtgggatgtactgacccctgaccccaatagctgcccacctctctatgtgctctggagggtccacagtgagtctggtatttggcctgggtggggagggtgggtcccatacccagagggctcagtgattctggtggccttctttcctttcatccaggccagatcccccagcgggtggtatggccaggccctgtacctgcatcccttagtttggcactgttggagtcagtgctgcgccatgttggactcaatgaagtgcacaaggctgtggggctcctgctggaaactctagggcccccacccactggcctgcacctgcagaggggaatctaccgtgagatattattcctgacaatggctgctctgggcaaggaccacgtggacatagtggccttcgataagaagtacaagtctgcctttaacaagctggccagcagcatgggcaaggaggagctgaggcaccggcgggcgcagatgcccactcccaaggccattgactgccgaaaatgttttggagcacctccagaatgctagagaccttaagcttccctctccagcctagggtggggaagtgaggaagaagggattctagagttaaactgcttccctgttgccttcatggagttgggaacaggctgggaaggatgcccagtcaaaggctccaagcgaggacaacaggaagagggatccactgttaccaaaagtcctgattcccccatcaccaacctacccagtttgttcgtgctgatgttgggggagatctggggggagttggtacagctctgttcttcccttgtcctataccgggaactcccctccagggtacccacagatctgcattgccctggtcattttagaagtttttgttttaaaaaacaactggaaagatgcagagctactgagcctttgccctgaatgggaggtagggatgtcattctccaccaataatggtccctcttccctgacgttgctgaaggagcccaaggctctccatgcctttctacctaagtgtttgtattttattttaaattatttattctggagccacagcccccttgcttatgaggttcttatggagagtgagaaagggaagggaaatagggcaccatggtccggtggtttgtagttccttcaaagtcaggcactgggagctagaggagtctcaagctccccttaggaagaactggtgccccctccagtcctaatttttcttgcctgccccgccttggggaatgcctcacccacccaggtcctgacctgtgcaataaggattgttccctgcgaagttttgttggatgtaaatatagtaaaagctgcttctgtcttt

SEQ ID NO: 361239 - DNA, 6253 bp, Homo sapiens
  misc_feature (6151)..(6151): n is a, c, g, or t
cgccggccgaggaggaggggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacaggcagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcaggtgagtggcccctttatccctccaatcctgtgaccctacatccctttgccctggtgcctcttggcaggcaccttaagtgtccccagagtttactttctctttgctactcgggccttctctgggatcccttggttcatttcccttggagtctgatggaccctgctccttttgggtacccccaactatgctgggggtgcagagctgctgggccgctacccggaggaggacaatgaggcgttcccgctgcccgagtcagtgcccgtcttctgcctgcccatgggggccactatcgagtgctggcctgcccagaccaagtaccccgtgcccgtcttctccacctttgtgctcacgggtgcagctggtgataaggtgtatggtgccgccctgcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgccttcctcaccttcctttaccgctactccgtctcaggcccccaccgcctacccttggaagcgcacatctcccacttcattcacaacgttcccttcccttccccacagagaccccgcatcctagtgcagatgtctccctatgacaacttgctcctctgtcagcctgtatcctcacccctgcccctcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcgatgatcttcccactgcactggcagtgcccctacattcctctgtgcccgctggtgctggcagatgtgctgagtgccccagtgcccttcattgtgggtatccactccagctactttgatctgcatgacccgcctgctgatgtcatctgtgtagaccttgataccaacacgctcttccagactgaggaaaagaagctcctctcccctcggaccctgccccgcagaccctacaaggttctgctggccacactgacaaacctgtaccagcagctggaccagacatacactggacctgaggaggaagcatccctggagttcctactgacagactacgaggcagtgtgtggccgcagggcccggctggagcgcgaagtccaaggagccttcctccgcttcatggcctgtctgctcaagggctaccgggtcttcctgcgcccactcacccaggccccctccgagggagctcgtgatgttgacaaccttttcttcctgcagggcttcctcaaatcccgggaacgctccagccacaaactttactctcagctgctgcacacacagatgttctcacagttcattgaggagtgctcttttggctctgctcgccatgctgcccttgaattctttgactcttgtgttgaaaaggtccacccagagcaggagaagcctgagccgacacccttagtggagctagaggagctgtcaggaagtgagctcactgtctttatcacacctcccgaggagcctgccttaccagagggcagtgaatccactccccagtactgctatgatggattcccagagctacgggctgagttgtttgagtctcttcaagagcaacctggggccctgcctgtgccaggcccttcccgtagcgcccccagcagtcctgctcctcgccgtaccaaacaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtgtgttaccgggtactgatgcagctctgctcacactatgggcagcctgtgctgtctgtgcgggtcatgctggagatgcgtcaggcaggcattgtgcccaacaccatcacctatggctactacaataaggctgtgttggaaagcaagtggccgtctggcacaccaggtgggcgtctgcgctgggccaagctccggaatgttgtcctgggggctgctcagttccgccagcccttgagagaacggcaacagcagcagcagcagcagcaacagcagcagcagcagcagcagcagcaggagcaggtgtcagcacatcaagaggcaggcagctcccaggcagagccctatttggagcgcccttcccctactcgccctcttcagcgccagactacttgggctgggcgaagtctgagagacccagcctcaccccctggacgcctggtgaagagtggtagcctgggcagtgcccgaggggcacagcccactgtggaggccggtgtggcccacatgatagaggccttgggggtcctggaaccccggggatcacctgtgccctggcacgatggaagtctctcagacctgagcctgacaggggaggagccgctccctggaggcagcccagggggctcaggctcagccctgagtgcccagtccactgaggccctggaagggctaagtgggcggggacccaaggctggtgggcgacaggatgaggcaggcaccccccgacgagggctgggtgcccgcctccaacagctgctcactccttcccgccactcccctgcctcccgcattcccccacctgagctgcctcctgacctgccacccccagcccgccgcagccccatggacagtcttctgcacccccgggagcgccctggatccactgcctccgagagctcagcctctctgggcagtgagtgggacctctcagaatcttctctcagcaacctgagtcttcgccgttcctcagagcgcctcagtgacacccctggatccttccagtcaccttccctggaaattctgctgtccagctgctccctgtgccgtgcctgtgattcgctggtgtatgatgaggaaatcatggctggctgggcacctgatgactctaacctcaacacaacctgccccttctgcgcctgcccctttgtgcccctgctcagtgtccagacccttgattcccggcccagtgtccccagccccaaatctgctggtgccagtggcagcaaagatgctcctgtccctggtggtcctggccctgtgctcagtgaccgaaggctctgccttgctctggatgagccccagctctgcaacgggcacatggggggagcctcccggcgggttgagagtggggcatgggcatacctgagccccctggtgctgcgtaaggagctggagtcgctggtagagaacgagggcagtgaggtgctggcgttgcctgaactgccctctgcccaccccatcatcttctggaaccttttgtggtatttccaacggctacgcctgcccagtattctaccaggcctggtgctggcctcctgtgatgggccttcgcactcccaggccccatctccttggctaacccctgatccagcctctgttcaggtacggctgctgtgggatgtactgacccctgaccccaatagctgcccacctctctatgtgctctggagggtccacagccagatcccccagcgggtggtatggccaggccctgtacctgcatcccttagtttggcactgttggagtcagtgctgcgccatgttggactcaatgaagtgcacaaggctgtggggctcctgctggaaactctagggcccccacccactggcctgcacctgcagaggggaatctaccgtgagatattattcctgacaatggctgctctgggcaaggaccacgtggacatagtggccttcgataagaagtacaagtctgcctttaacaagctggccagcagcatgggcaaggaggagctgaggcaccggcgggcgcagatgcccactcccaaggccattgactgccgaaaatgttttggagcacctccagaatgctagagaccttaagcttccctctccagcctagggtggggaagtgaggaagaagggattctagagttaaactgcttccctgttgccttcatggagttgggaacaggctgggaaggatgcccagtcaaaggctccaagcgaggacaacaggaagagggatccactgttaccaaaagtcctgattcccccatcaccaacctacccagtttgttcgtgctgatgttgggggagatctggggggagttggtacagctctgttcttcccttgtcctataccgggaactcccctccagggtacccacagatctgcattgccctggtcattttagaagtttttgttttaaaaaacaactggaaagatgcagagctactgagcctttgccctgaatgggaggtagggatgtcattctccaccaataatggtccctcttccctgacgttgctgaaggagcccaaggctctccatgcctttctacctaagtgtttgtattttattttaaattatttattctggagccacagcccccttgcttatgaggttcttatggagagtgagaaagggaagggaaatagggcaccatggtccggtggtttgtagttccttcaaagtcaggcactgggagctagaggagtctcaagctccccttaggaagaactggtgccccctccagtcctaatttttcttgcctgccccgccttggggaatgcctcacccacccaggtcctgacctgtgcaataaggattgttccctgcgaagttttgttggatgtaaatatagtaaaagctgcttctgtctttagaaaaaaaacaacaacaaaaaaaaaattttggggggcctgggcccgaaaaattttttaaacctcgttgggggcggggcccatttgttactcgacctgggcctaacgcgcccaaggaaaccgcccaggattagtgtgcggtctcccccataaaaagcggggccccgctttttgaacaaccgaaggccttcgggcttccggtttacacagggtcaggcgatcgatacaaccccccggtcgggntagtaaatacacccgtgggtaaccatactgagaaagacacaaacacaaacaaaaacgcagaacaaccgggcataccaaacagcaccaaaacaatccataagc

SEQ ID NO: 361240 - DNA, 4678 bp, Homo sapiens
cgccggccgaggaggaggggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacaggcagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcaggtgagtggcccctttatccctccaatcctgtgaccctacatccctttgccctggtgcctcttggcaggcaccttaagtgtccccagagtttactttctctttgctactcgggccttctctgggatcccttggttcatttcccttggagtctgatggaccctgctccttttgggtacccccaactatgctgggggtgcagagctgctgggccgctacccggaggaggacaatgaggcgttcccgctgcccgagtcagtgcccgtcttctgcctgcccatgggggccactatcgagtgctggcctgcccagaccaagtaccccgtgcccgtcttctccacctttgtgctcacgggtgcagctggtgataaggtgtatggtgccgccctgcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgccttcctcaccttcctttaccgctactccgtctcaggcccccaccgcctacccttggaagcgcacatctcccacttcattcacaacgttcccttcccttccccacagagaccccgcatcctagtgcagatgtctccctatgacaacttgctcctctgtcagcctgtatcctcacccctgcccctcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcgatgatcttcccactgcactggcagtgcccctacattcctctgtgcccgctggtgctggcagatgtgctgagtgccccagtgcccttcattgtgggtatccactccagctactttgatctgcatgacccgcctgctgatgtcatctgtgtagaccttgataccaacacgctcttccagactgaggaaaagaagctcctctcccctcggaccctgccccgcagaccctacaaggttctgctggccacactgacaaacctgtaccagcagctggaccagacatacactggacctgaggaggaagcatccctggagttcctactgacagactacgaggcagtgtgtggccgcagggcccggctggagcgcgaagtccaaggagccttcctccgcttcatggcctgtctgctcaagggctaccgggtcttcctgcgcccactcacccaggccccctccgagggagctcgtgatgttgacaaccttttcttcctgcagggcttcctcaaatcccgggaacgctccagccacaaactttactctcagctgctgcacacacagatgttctcacagttcattgaggagtgctcttttggctctgctcgccatgctgcccttgaattctttgactcttgtgttgaaaaggtccacccagagcaggagaagcctgagccgacacccttagtggagctagaggagctgtcaggaagtgagctcactgtctttatcacacctcccgaggagcctgccttaccagagggcagtgaatccactccccagtactgctatgatggattcccagagctacgggctgagttgtttgagtctcttcaagagcaacctggggccctgcctgtgccaggcccttcccgtagcgcccccagcagtcctgctcctcgccgtaccaaacaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtgtgttaccgggtactgatgcagctctgctcacactatgggcagcctgtgctgtctgtgcgggtcatgctggagatgcgtcaggcaggcattgtgcccaacaccatcacctatggctactacaataaggctgtgttggaaagcaagtggccgtctggcacaccaggtgggcgtctgcgctgggccaagctccggaatgttgtcctgggggctgctcagttccgccagcccttgagagaacggcaacagcagcagcagcagcagcaacagcagcagcagcagcagcagcagcaggagcaggtgtcagcacatcaagaggcaggcagctcccaggcagagccctatttggagcgcccttcccctactcgccctcttcagcgccagactacttgggctgggcgaagtctgagagacccagcctcaccccctggacgcctggtgaagagtggtagcctgggcagtgcccgaggggcacagcccactgtggaggccggtgtggcccacatgatagaggccttgggggtcctggaaccccggggatcacctgtgccctggcacgatggaagtctctcagacctgagcctgacaggggaggagccgctccctggaggcagcccagggggctcaggctcagccctgagtgcccagtccactgaggccctggaagggctaagtgggcggggacccaaggctggtgggcgacaggatgaggcaggcaccccccgacgagggctgggtgcccgcctccaacagctgctcactccttcccgccactcccctgcctcccgcattcccccacctgagctgcctcctgacctgccacccccagcccgccgcagccccatggacagtcttctgcacccccgggagcgccctggatccactgcctccgagagctcagcctctctgggcagtgagtgggacctctcagaatcttctctcagcaacctgagtcttcgccgttcctcagagcgcctcagtgacacccctggatccttccagtcaccttccctggaaattctgctgtccagctgctccctgtgccgtgcctgtgattcgctggtgtatgatgaggaaatcatggctggctgggcacctgatgactctaacctcaacacaacctgccccttctgcgcctgcccctttgtgcccctgctcagtgtccagacccttgattcccggcccagtgtccccagccccaaatctgctggtgccagtggcagcaaagatgctcctgtccctggtggtcctggccctgtgctcagtgaccgaaggctctgccttgctctggatgagccccagctctgcaacgggcacatggggggagcctcccggcgggttgagagtggggcatgggcatacctgagccccctggtgctgcgtaaggagctggagtcgctggtagagaacgagggcagtgaggtgctggcgttgcctgaactgccctctgcccaccccatcatcttctggaaccttttgtggtatttgttggcatagtggtagttgctaaaactgtgataaaaagaagttaagagaaactgtgtgaaagtaagcctgtcacacttgtataaagaaggttagttccccaccacctcagggccagaaccacaaatatcg

SEQ ID NO: 361241 - DNA, 3361 bp, Homo sapiens
cgccggccgaggaggaggggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacaggcagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcaggtgagtggcccctttatccctccaatcctgtgaccctacatccctttgccctggtgcctcttggcaggcaccttaagtgtccccagagtttactttctctttgctactcgggccttctctgggatcccttggttcatttcccttggagtctgatggaccctgctccttttgggtacccccaactatgctgggggtgcagagctgctgggccgctacccggaggaggacaatgaggcgttcccgctgcccgagtcagtgcccgtcttctgcctgcccatgggggccactatcgagtgctggcctgcccagaccaagtaccccgtgcccgtcttctccacctttgtgctcacgggtgcagctggtgataaggtgtatggtgccgccctgcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgccttcctcaccttcctttaccgctactccgtctcaggcccccaccgcctacccttggaagcgcacatctcccacttcattcacaacgttcccttcccttccccacagagaccccgcatcctagtgcagatgtctccctatgacaacttgctcctctgtcagcctgtatcctcacccctgcccctcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcgatgatcttcccactgcactggcagtgcccctacattcctctgtgcccgctggtgctggcagatgtgctgagtgccccagtgcccttcattgtgggtatccactccagctactttgatctgcatgacccgcctgctgatgtcatctgtgtagaccttgataccaacacgctcttccagactgaggaaaagaagctcctctcccctcggaccctgccccgcagaccctacaaggttctgctggccacactgacaaacctgtaccagcagctggaccagacatacactggacctgaggaggaagcatccctggagttcctactgacagactacgaggcagtgtgtggccgcagggcccggctggagcgcgaagtccaaggagccttcctccgcttcatggcctgtctgctcaagggctaccgggtcttcctgcgcccactcacccaggccccctccgagggagctcgtgatgttgacaaccttttcttcctgcagggcttcctcaaatcccgggaacgctccagccacaaactttactctcagctgctgcacacacagatgttctcacagttcattgaggagtgctcttttggctctgctcgccatgctgcccttgaattctttgactcttgtgttgaaaaggtccacccagagcaggagaagcctgagccgacacccttagtggagctagaggagctgtcaggaagtgagctcactgtctttatcacacctcccgaggagcctgccttaccagagggcagtgaatccactccccagtactgctatgatggattcccagagctacgggctgagttgtttgagtctcttcaagagcaacctggggccctgcctgtgccaggcccttcccgtagcgcccccagcagtcctgctcctcgccgtaccaaacaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccatgcctttctacctaagtgtttgtattttattttaaattatttattctggagccacagcccccttgcttatgaggttcttatggagagtgagaaagggaagggaaatagggcaccatggtccggtggtttgtagttccttcaaagtcaggcactgggagctagaggagtctcaagctccccttaggaagaactggtgccccctccagtcctaatttttcttgcctgccccgccttggggaatgcctcacccacccaggtcctgacctgtgcaataaggattgttccctgcgaagttttgttggatgtaaatatagtaaaagctgcttctgtcttt

SEQ ID NO: 361242 - DNA, 3417 bp, Homo sapiens
cgccggccgaggaggaggggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacaggcagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcaggtgagtggcccctttatccctccaatcctgtgaccctacatccctttgccctggtgcctcttggcaggcaccttaagtgtccccagagtttactttctctttgctactcgggccttctctgggatcccttggttcatttcccttggagtctgatggaccctgctccttttgggtacccccaactatgctgggggtgcagagctgctgggccgctacccggaggaggacaatgaggcgttcccgctgcccgagtcagtgcccgtcttctgcctgcccatgggggccactatcgagtgctggcctgcccagaccaagtaccccgtgcccgtcttctccacctttgtgctcacgggtgcagctggtgataaggtgtatggtgccgccctgcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgccttcctcaccttcctttaccgctactccgtctcaggcccccaccgcctacccttggaagcgcacatctcccacttcattcacaacgttcccttcccttccccacagagaccccgcatcctagtgcagatgtctccctatgacaacttgctcctctgtcagcctgtatcctcacccctgcccctcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcgatgatcttcccactgcactggcagtgcccctacattcctctgtgcccgctggtgctggcagatgtgctgagtgccccagtgcccttcattgtgggtatccactccagctactttgatctgcatgacccgcctgctgatgtcatctgtgtagaccttgataccaacacgctcttccagactgaggaaaagaagctcctctcccctcggaccctgccccgcagaccctacaaggttctgctggccacactgacaaacctgtaccagcagctggaccagacatacactggacctgaggaggaagcatccctggagttcctactgacagactacgaggcagtgtgtggccgcagggcccggctggagcgcgaagtccaaggagccttcctccgcttcatggcctgtctgctcaagggctaccgggtcttcctgcgcccactcacccaggccccctccgagggagctcgtgatgttgacaaccttttcttcctgcagggcttcctcaaatcccgggaacgctccagccacaaactttactctcagctgctgcacacacagatgttctcacagttcattgaggagtgctcttttggctctgctcgccatgctgcccttgaattctttgactcttgtgttgaaaaggtccacccagagcaggagaagcctgagccgacacccttagtggagctagaggagctgtcaggaagtgagctcactgtctttatcacacctcccgaggagcctgccttaccagagggcagtgaatccactccccagtactgctatgatggattcccagagctacgggctgagttgtttgagtctcttcaagagcaacctggggccctgcctgtgccaggcccttcccgtagcgcccccagcagtcctgctcctcgccgtaccaaacaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtgtgttaccgggtactgatgcagctctgctcacactatgggcagcctgtgctgtctgtgcgggtcatgctggagatgcgtcaggcaggcattgtgcccaacaccatcacctatggctactacaataaggtacctactttggggtgaggggtgggatggcagctgtgccagggtgtgtgaggggaggctgctgctgctcccctcgctccttggagattgggctggtactgtttgcctaggtcctggaaccactgtcatccacattgcactcctgtggtgccttagcacctacagtttctcagacgaggctgctttgattcccactcatgacagccctgcctacaactaatagtgtc

SEQ ID NO: 361243 - DNA, 2530 bp, Homo sapiens
cgccggccgaggaggaggggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacaggcagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcagagctgctgggccgctacccggaggaggacaatgaggcgttcccgctgcccgagtcagtgcccgtcttctgcctgcccatgggggccactatcgagtgctggcctgcccagaccaagtaccccgtgcccgtcttctccacctttgtgctcacgggtgcagctggtgataaggtgtatggtgccgccctgcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgccttcctcaccttcctttaccgctactccgtctcaggcccccaccgcctacccttggaagcgcacatctcccacttcattcacaacgttcccttcccttccccacagagaccccgcatcctagtgcagatgtctccctatgacaacttgctcctctgtcagcctgtatcctcacccctgcccctcaggtatgtgatcagattgtggggaggggagcctttaatgaccaaggacatggtaggtgctgggcaggtgggtgcagctgttgaggtttatgcaggctgggtccaggtggtggctgtgcctggcatctggggaagggtccccagggtatcctggtgaccctttccccacctcggcattgcctgcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcggtgagtgccgccccgcctggcccatcttccccagaaccatggttctttctggtgcccctatccctgcctggactcttcccttttccttccttgtggaggatcctcagcccctttccctgggcacagcctgcaggaacacatagcttccatcaggagctcttctctagagcctacttccaacagcctctctcaacaggcaccaactccccaaggccaatgccctctctttctctctcctgtgcctcccactgctgcctcaaccccctgttcactggttctcactgcctggtgcttcagatgatcttcccactgcactggcagtgcccctacattcctctgtgcccgctggtgctggcagatgtgctgagtgccccagtgcccttcattgtgggtatccactccagctactttgatctgcatgacccgcctgctgatgtcatctgtgtagaccttgataccaacacgctcttccagactgaggaaaagaagctcctctcccctcggaccctgccccgcagaccctacaaggttctgctggccacactgacaaacctgtaccagcagctggaccagaggagcagcaggaggattccacaaa

SEQ ID NO: 361244 - DNA, 876 bp, Homo sapiens
cgccggccgaggaggaggggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacaggcagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctgcactcttacgaaaagcggctgtactgaggacagcggtggaggccgaggtggtggaggggatgcaccccagtgtccactttcggacacaagcctccctccag

SEQ ID NO: 361245 - DNA, 764 bp, Homo sapiens
tagataagtaagaaagacctggcattgtactcaccctgatgtgtcccctgtcctacctaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtaggcaatctatgtgaccatgctcatacccaggcccagtgagccttgtgcagctggagagggctgtgagagggaaacttggtggagactaaggaaagaagttgcagagccccagagctgggcagattatctataaacattcgtcgagtgaataagcatgttcagggtttagcagtgaagactgtagggtggcagggtcagcagaaagggtgggtggctctgaggtagccccaggacctgccaggggccagtgatgtctgtgagaattggggaggcaggaagagggtgcttgctgagactttggttttggttgagagtgagtctcccattgtcctgtgcctctcctggcccaggtgtgttaccgggtactgatgcagctctgctcacactatgggcagcctgtgctgtctgtgcgggtcatgctggagatgcgtcaggcaggcattgtgcccaacaccatcacctatggctactacaataaggtacctactttgggg

SEQ ID NO: 361246 - DNA, 5519 bp, Homo sapiens
cgccggccgaggaggaggggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacaggcagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgccttcctcaccttcctttaccgctactccgtctcaggcccccaccgcctacccttggaagcgcacatctcccacttcattcacaacgttcccttcccttccccacagagaccccgcatcctagtgcagatgtctccctatgacaacttgctcctctgtcagcctgtatcctcacccctgcccctcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcgatgatcttcccactgcactggcagtgcccctacattcctctgtgcccgctggtgctggcagatgtgctgagtgccccagtgcccttcattgtgggtatccactccagctactttgatctgcatgacccgcctgctgatgtcatctgtgtagaccttgataccaacacgctcttccagactgaggaaaagaagctcctctcccctcggaccctgccccgcagaccctacaaggttctgctggccacactgacaaacctgtaccagcagctggaccagacatacactggacctgaggaggaagcatccctggagttcctactgacagactacgaggcagtgtgtggccgcagggcccggctggagcgcgaagtccaaggagccttcctccgcttcatggcctgtctgctcaagggctaccgggtcttcctgcgcccactcacccaggccccctccgagggagctcgtgatgttgacaaccttttcttcctgcagggcttcctcaaatcccgggaacgctccagccacaaactttactctcagctgctgcacacacagatgttctcacagttcattgaggagtgctcttttggctctgctcgccatgctgcccttgaattctttgactcttgtgttgaaaaggtccacccagagcaggagaagcctgagccgacacccttagtggagctagaggagctgtcaggaagtgagctcactgtctttatcacacctcccgaggagcctgccttaccagagggcagtgaatccactccccagtactgctatgatggattcccagagctacgggctgagttgtttgagtctcttcaagagcaacctggggccctgcctgtgccaggcccttcccgtagcgcccccagcagtcctgctcctcgccgtaccaaacaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtgtgttaccgggtactgatgcagctctgctcacactatgggcagcctgtgctgtctgtgcgggtcatgctggagatgcgtcaggcaggcattgtgcccaacaccatcacctatggctactacaataaggctgtgttggaaagcaagtggccgtctggcacaccaggtgggcgtctgcgctgggccaagctccggaatgttgtcctgggggctgctcagttccgccagcccttgagagaacggcaacagcagcagcagcagcagcaacagcagcagcagcagcagcagcagcaggagcaggtgtcagcacatcaagaggcaggcagctcccaggcagagccctatttggagcgcccttcccctactcgccctcttcagcgccagactacttgggctgggcgaagtctgagagacccagcctcaccccctggacgcctggtgaagagtggtagcctgggcagtgcccgaggggcacagcccactgtggaggccggtgtggcccacatgatagaggccttgggggtcctggaaccccggggatcacctgtgccctggcacgatggaagtctctcagacctgagcctgacaggggaggagccgctccctggaggcagcccagggggctcaggctcagccctgagtgcccagtccactgaggccctggaagggctaagtgggcggggacccaaggctggtgggcgacaggatgaggcaggcaccccccgacgagggctgggtgcccgcctccaacagctgctcactccttcccgccactcccctgcctcccgcattcccccacctgagctgcctcctgacctgccacccccagcccgccgcagccccatggacagtcttctgcacccccgggagcgccctggatccactgcctccgagagctcagcctctctgggcagtgagtgggacctctcagaatcttctctcagcaacctgagtcttcgccgttcctcagagcgcctcagtgacacccctggatccttccagtcaccttccctggaaattctgctgtccagctgctccctgtgccgtgcctgtgattcgctggtgtatgatgaggaaatcatggctggctgggcacctgatgactctaacctcaacacaacctgccccttctgcgcctgcccctttgtgcccctgctcagtgtccagacccttgattcccggcccagtgtccccagccccaaatctgctggtgccagtggcagcaaagatgctcctgtccctggtggtcctggccctgtgctcagtgaccgaaggctctgccttgctctggatgagccccagctctgcaacgggcacatggggggagcctcccggcgggttgagagtggggcatgggcatacctgagccccctggtgctgcgtaaggagctggagtcgctggtagagaacgagggcagtgaggtgctggcgttgcctgaactgccctctgcccaccccatcatcttctggaaccttttgtggtatttccaacggctacgcctgcccagtattctaccaggcctggtgctggcctcctgtgatgggccttcgcactcccaggccccatctccttggctaacccctgatccagcctctgttcaggtacggctgctgtgggatgtactgacccctgaccccaatagctgcccacctctctatgtgctctggagggtccacagccagatcccccagcgggtggtatggccaggccctgtacctgcatcccttagtttggcactgttggagtcagtgctgcgccatgttggactcaatgaagtgcacaaggctgtggggctcctgctggaaactctagggcccccacccactggcctgcacctgcagaggggaatctaccgtgagatattattcctgacaatggctgctctgggcaaggaccacgtggacatagtggccttcgataagaagtacaagtctgcctttaacaagctggccagcagcatgggcaaggaggagctgaggcaccggcgggcgcagatgcccactcccaaggccattgactgccgaaaatgttttggagcacctccagaatgctagagaccttaagcttccctctccagcctagggtggggaagtgaggaagaagggattctagagttaaactgcttccctgttgccttcatggagttgggaacaggctgggaaggatgcccagtcaaaggctccaagcgaggacaacaggaagagggatccactgttaccaaaagtcctgattcccccatcaccaacctacccagtttgttcgtgctgatgttgggggagatctggggggagttggtacagctctgttcttcccttgtcctataccgggaactcccctccagggtacccacagatctgcattgccctggtcattttagaagtttttgttttaaaaaacaactggaaagatgcagagctactgagcctttgccctgaatgggaggtagggatgtcattctccaccaataatggtccctcttccctgacgttgctgaaggagcccaaggctctccatgcctttctacctaagtgtttgtattttattttaaattatttattctggagccacagcccccttgcttatgaggttcttatggagagtgagaaagggaagggaaatagggcaccatggtccggtggtttgtagttccttcaaagtcaggcactgggagctagaggagtctcaagctccccttaggaagaactggtgccccctccagtcctaatttttcttgcctgccccgccttggggaatgcctcacccacccaggtcctgacctgtgcaataaggattgttccctgcgaagttttgttggatgtaaatatagtaaaagctgcttctgtcttt

SEQ ID NO: 361247 - DNA, 5710 bp, Homo sapiens
cgccggccgaggaggaggggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacaggcagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcagagctgctgggccgctacccggaggaggacaatgaggcgttcccgctgcccgagtcagtgcccgtcttctgcctgcccatgggggccactatcgagtgctggcctgcccagaccaagtaccccgtgcccgtcttctccacctttgtgctcacgggtgcagctggtgataaggtgtatggtgccgccctgcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgccttcctcaccttcctttaccgctactccgtctcaggcccccaccgcctacccttggaagcgcacatctcccacttcattcacaacgttcccttcccttccccacagagaccccgcatcctagtgcagatgtctccctatgacaacttgctcctctgtcagcctgtatcctcacccctgcccctcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcgatgatcttcccactgcactggcagtgcccctacattcctctgtgcccgctggtgctggcagatgtgctgagtgccccagtgcccttcattgtgggtatccactccagctactttgatctgcatgacccgcctgctgatgtcatctgtgtagaccttgataccaacacgctcttccagactgaggaaaagaagctcctctcccctcggaccctgccccgcagaccctacaaggttctgctggccacactgacaaacctgtaccagcagctggaccagacatacactggacctgaggaggaagcatccctggagttcctactgacagactacgaggcagtgtgtggccgcagggcccggctggagcgcgaagtccaaggagccttcctccgcttcatggcctgtctgctcaagggctaccgggtcttcctgcgcccactcacccaggccccctccgagggagctcgtgatgttgacaaccttttcttcctgcagggcttcctcaaatcccgggaacgctccagccacaaactttactctcagctgctgcacacacagatgttctcacagttcattgaggagtgctcttttggctctgctcgccatgctgcccttgaattctttgactcttgtgttgaaaaggtccacccagagcaggagaagcctgagccgacacccttagtggagctagaggagctgtcaggaagtgagctcactgtctttatcacacctcccgaggagcctgccttaccagagggcagtgaatccactccccagtactgctatgatggattcccagagctacgggctgagttgtttgagtctcttcaagagcaacctggggccctgcctgtgccaggcccttcccgtagcgcccccagcagtcctgctcctcgccgtaccaaacaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtgtgttaccgggtactgatgcagctctgctcacactatgggcagcctgtgctgtctgtgcgggtcatgctggagatgcgtcaggcaggcattgtgcccaacaccatcacctatggctactacaataaggctgtgttggaaagcaagtggccgtctggcacaccaggtgggcgtctgcgctgggccaagctccggaatgttgtcctgggggctgctcagttccgccagcccttgagagaacggcaacagcagcagcagcagcagcaacagcagcagcagcagcagcagcagcaggagcaggtgtcagcacatcaagaggcaggcagctcccaggcagagccctatttggagcgcccttcccctactcgccctcttcagcgccagactacttgggctgggcgaagtctgagagacccagcctcaccccctggacgcctggtgaagagtggtagcctgggcagtgcccgaggggcacagcccactgtggaggccggtgtggcccacatgatagaggccttgggggtcctggaaccccggggatcacctgtgccctggcacgatggaagtctctcagacctgagcctgacaggggaggagccgctccctggaggcagcccagggggctcaggctcagccctgagtgcccagtccactgaggccctggaagggctaagtgggcggggacccaaggctggtgggcgacaggatgaggcaggcaccccccgacgagggctgggtgcccgcctccaacagctgctcactccttcccgccactcccctgcctcccgcattcccccacctgagctgcctcctgacctgccacccccagcccgccgcagccccatggacagtcttctgcacccccgggagcgccctggatccactgcctccgagagctcagcctctctgggcagtgagtgggacctctcagaatcttctctcagcaacctgagtcttcgccgttcctcagagcgcctcagtgacacccctggatccttccagtcaccttccctggaaattctgctgtccagctgctccctgtgccgtgcctgtgattcgctggtgtatgatgaggaaatcatggctggctgggcacctgatgactctaacctcaacacaacctgccccttctgcgcctgcccctttgtgcccctgctcagtgtccagacccttgattcccggcccagtgtccccagccccaaatctgctggtgccagtggcagcaaagatgctcctgtccctggtggtcctggccctgtgctcagtgaccgaaggctctgccttgctctggatgagccccagctctgcaacgggcacatggggggagcctcccggcgggttgagagtggggcatgggcatacctgagccccctggtgctgcgtaaggagctggagtcgctggtagagaacgagggcagtgaggtgctggcgttgcctgaactgccctctgcccaccccatcatcttctggaaccttttgtggtatttccaacggctacgcctgcccagtattctaccaggcctggtgctggcctcctgtgatgggccttcgcactcccaggccccatctccttggctaacccctgatccagcctctgttcaggtacggctgctgtgggatgtactgacccctgaccccaatagctgcccacctctctatgtgctctggagggtccacagccagatcccccagcgggtggtatggccaggccctgtacctgcatcccttagtttggcactgttggagtcagtgctgcgccatgttggactcaatgaagtgcacaaggctgtggggctcctgctggaaactctagggcccccacccactggcctgcacctgcagaggggaatctaccgtgagatattattcctgacaatggctgctctgggcaaggaccacgtggacatagtggccttcgataagaagtacaagtctgcctttaacaagctggccagcagcatgggcaaggaggagctgaggcaccggcgggcgcagatgcccactcccaaggccattgactgccgaaaatgttttggagcacctccagaatgctagagaccttaagcttccctctccagcctagggtggggaagtgaggaagaagggattctagagttaaactgcttccctgttgccttcatggagttgggaacaggctgggaaggatgcccagtcaaaggctccaagcgaggacaacaggaagagggatccactgttaccaaaagtcctgattcccccatcaccaacctacccagtttgttcgtgctgatgttgggggagatctggggggagttggtacagctctgttcttcccttgtcctataccgggaactcccctccagggtacccacagatctgcattgccctggtcattttagaagtttttgttttaaaaaacaactggaaagatgcagagctactgagcctttgccctgaatgggaggtagggatgtcattctccaccaataatggtccctcttccctgacgttgctgaaggagcccaaggctctccatgcctttctacctaagtgtttgtattttattttaaattatttattctggagccacagcccccttgcttatgaggttcttatggagagtgagaaagggaagggaaatagggcaccatggtccggtggtttgtagttccttcaaagtcaggcactgggagctagaggagtctcaagctccccttaggaagaactggtgccccctccagtcctaatttttcttgcctgccccgccttggggaatgcctcacccacccaggtcctgacctgtgcaataaggattgttccctgcgaagttttgttggatgtaaatatagtaaaagctgcttctgtcttt

SEQ ID NO: 361248 - DNA, 5540 bp, Homo sapiens
cgccggccgaggaggaggggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacaggcagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcaggtgtatggtgccgccctgcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgccttcctcaccttcctttaccgctactccgtctcaggcccccaccgcctacccttggaagcgcacatctcccacttcattcacaacgttcccttcccttccccacagagaccccgcatcctagtgcagatgtctccctatgacaacttgctcctctgtcagcctgtatcctcacccctgcccctcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcgatgatcttcccactgcactggcagtgcccctacattcctctgtgcccgctggtgctggcagatgtgctgagtgccccagtgcccttcattgtgggtatccactccagctactttgatctgcatgacccgcctgctgatgtcatctgtgtagaccttgataccaacacgctcttccagactgaggaaaagaagctcctctcccctcggaccctgccccgcagaccctacaaggttctgctggccacactgacaaacctgtaccagcagctggaccagacatacactggacctgaggaggaagcatccctggagttcctactgacagactacgaggcagtgtgtggccgcagggcccggctggagcgcgaagtccaaggagccttcctccgcttcatggcctgtctgctcaagggctaccgggtcttcctgcgcccactcacccaggccccctccgagggagctcgtgatgttgacaaccttttcttcctgcagggcttcctcaaatcccgggaacgctccagccacaaactttactctcagctgctgcacacacagatgttctcacagttcattgaggagtgctcttttggctctgctcgccatgctgcccttgaattctttgactcttgtgttgaaaaggtccacccagagcaggagaagcctgagccgacacccttagtggagctagaggagctgtcaggaagtgagctcactgtctttatcacacctcccgaggagcctgccttaccagagggcagtgaatccactccccagtactgctatgatggattcccagagctacgggctgagttgtttgagtctcttcaagagcaacctggggccctgcctgtgccaggcccttcccgtagcgcccccagcagtcctgctcctcgccgtaccaaacaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtgtgttaccgggtactgatgcagctctgctcacactatgggcagcctgtgctgtctgtgcgggtcatgctggagatgcgtcaggcaggcattgtgcccaacaccatcacctatggctactacaataaggctgtgttggaaagcaagtggccgtctggcacaccaggtgggcgtctgcgctgggccaagctccggaatgttgtcctgggggctgctcagttccgccagcccttgagagaacggcaacagcagcagcagcagcagcaacagcagcagcagcagcagcagcagcaggagcaggtgtcagcacatcaagaggcaggcagctcccaggcagagccctatttggagcgcccttcccctactcgccctcttcagcgccagactacttgggctgggcgaagtctgagagacccagcctcaccccctggacgcctggtgaagagtggtagcctgggcagtgcccgaggggcacagcccactgtggaggccggtgtggcccacatgatagaggccttgggggtcctggaaccccggggatcacctgtgccctggcacgatggaagtctctcagacctgagcctgacaggggaggagccgctccctggaggcagcccagggggctcaggctcagccctgagtgcccagtccactgaggccctggaagggctaagtgggcggggacccaaggctggtgggcgacaggatgaggcaggcaccccccgacgagggctgggtgcccgcctccaacagctgctcactccttcccgccactcccctgcctcccgcattcccccacctgagctgcctcctgacctgccacccccagcccgccgcagccccatggacagtcttctgcacccccgggagcgccctggatccactgcctccgagagctcagcctctctgggcagtgagtgggacctctcagaatcttctctcagcaacctgagtcttcgccgttcctcagagcgcctcagtgacacccctggatccttccagtcaccttccctggaaattctgctgtccagctgctccctgtgccgtgcctgtgattcgctggtgtatgatgaggaaatcatggctggctgggcacctgatgactctaacctcaacacaacctgccccttctgcgcctgcccctttgtgcccctgctcagtgtccagacccttgattcccggcccagtgtccccagccccaaatctgctggtgccagtggcagcaaagatgctcctgtccctggtggtcctggccctgtgctcagtgaccgaaggctctgccttgctctggatgagccccagctctgcaacgggcacatggggggagcctcccggcgggttgagagtggggcatgggcatacctgagccccctggtgctgcgtaaggagctggagtcgctggtagagaacgagggcagtgaggtgctggcgttgcctgaactgccctctgcccaccccatcatcttctggaaccttttgtggtatttccaacggctacgcctgcccagtattctaccaggcctggtgctggcctcctgtgatgggccttcgcactcccaggccccatctccttggctaacccctgatccagcctctgttcaggtacggctgctgtgggatgtactgacccctgaccccaatagctgcccacctctctatgtgctctggagggtccacagccagatcccccagcgggtggtatggccaggccctgtacctgcatcccttagtttggcactgttggagtcagtgctgcgccatgttggactcaatgaagtgcacaaggctgtggggctcctgctggaaactctagggcccccacccactggcctgcacctgcagaggggaatctaccgtgagatattattcctgacaatggctgctctgggcaaggaccacgtggacatagtggccttcgataagaagtacaagtctgcctttaacaagctggccagcagcatgggcaaggaggagctgaggcaccggcgggcgcagatgcccactcccaaggccattgactgccgaaaatgttttggagcacctccagaatgctagagaccttaagcttccctctccagcctagggtggggaagtgaggaagaagggattctagagttaaactgcttccctgttgccttcatggagttgggaacaggctgggaaggatgcccagtcaaaggctccaagcgaggacaacaggaagagggatccactgttaccaaaagtcctgattcccccatcaccaacctacccagtttgttcgtgctgatgttgggggagatctggggggagttggtacagctctgttcttcccttgtcctataccgggaactcccctccagggtacccacagatctgcattgccctggtcattttagaagtttttgttttaaaaaacaactggaaagatgcagagctactgagcctttgccctgaatgggaggtagggatgtcattctccaccaataatggtccctcttccctgacgttgctgaaggagcccaaggctctccatgcctttctacctaagtgtttgtattttattttaaattatttattctggagccacagcccccttgcttatgaggttcttatggagagtgagaaagggaagggaaatagggcaccatggtccggtggtttgtagttccttcaaagtcaggcactgggagctagaggagtctcaagctccccttaggaagaactggtgccccctccagtcctaatttttcttgcctgccccgccttggggaatgcctcacccacccaggtcctgacctgtgcaataaggattgttccctgcgaagttttgttggatgtaaatatagtaaaagctgcttctgtcttt

SEQ ID NO: 361249 - DNA, 5833 bp, Homo sapiens
cgccggccgaggaggaggggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacaggcagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcaggtgagtggcccctttatccctccaatcctgtgaccctacatccctttgccctggtgcctcttggcaggcaccttaagtgtccccagagtttactttctctttgctactcgggccttctctgggatcccttggttcatttcccttggagtctgatggaccctgctccttttgggtacccccaactatgctgggggtgcagagctgctgggccgctacccggaggaggacaatgaggcgttcccgctgcccgagtcagtgcccgtcttctgcctgcccatgggggccactatcgagtgctggcctgcccagaccaagtaccccgtgcccgtcttctccacctttgtgctcacgggtgcagctggtgataaggtgtatggtgccgccctgcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgccttcctcaccttcctttaccgctactccgtctcaggcccccaccgcctacccttggaagcgcacatctcccacttcattcacaacgttcccttcccttccccacagagaccccgcatcctagtgcagatgtctccctatgacaacttgctcctctgtcagcctgtatcctcacccctgcccctcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcgatgatcttcccactgcactggcagtgcccctacattcctctgtgcccgctggtgctggcagatgtgctgagtgccccagtgcccttcattgtgggtatccactccagctactttgatctgcatgacccgcctgctgatgtcatctgtgtagaccttgataccaacacgctcttccagactgaggaaaagaagctcctctcccctcggaccctgccccgcagaccctacaaggttctgctggccacactgacaaacctgtaccagcagctggaccagacatacactggacctgaggaggaagcatccctggagttcctactgacagactacgaggcagtgtgtggccgcagggcccggctggagcgcgaagtccaaggagccttcctccgcttcatggcctgtctgctcaagggctaccgggtcttcctgcgcccactcacccaggccccctccgagggagctcgtgatgttgacaaccttttcttcctgcagggcttcctcaaatcccgggaacgctccagccacaaactttactctcagctgctgcacacacagatgttctcacagttcattgaggagtgctcttttggctctgctcgccatgctgcccttgaattctttgactcttgtgttgaaaaggtccacccagagcaggagaagcctgagccgacacccttagtggagctagaggagctgtcaggaagtgagctcactgtctttatcacacctcccgaggagcctgccttaccagagggcagtgaatccactccccagtactgctatgatggattcccagagctacgggctgagttgtttgagtctcttcaagagcaacctggggccctgcctgtgccaggcccttcccgtagcgcccccagcagtcctgctcctcgccgtaccaaacaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtgtgttaccgggtactgatgcagctctgctcacactatgggcagcctgtgctgtctgtgcgggtcatgctggagatgcgtcaggcaggcattgtgcccaacaccatcacctatggctactacaataaggctgtgttggaaagcaagtggccgtctggcacaccaggtgggcgtctgcgctgggccaagctccggaatgttgtcctgggggctgctcagttccgccagcccttgagagaacggcaacagcagcagcagcagcagcaacagcagcagcagcagcagcagcagcaggagcaggtgtcagcacatcaagaggcaggcagctcccaggcagagccctatttggagcgcccttcccctactcgccctcttcagcgccagactacttgggctgggcgaagtctgagagacccagcctcaccccctggacgcctggtgaagagtggtagcctgggcagtgcccgaggggcacagcccactgtggaggccggtgtggcccacatgatagaggccttgggggtcctggaaccccggggatcacctgtgccctggcacgatggaagtctctcagacctgagcctgacaggggaggagccgctccctggaggcagcccagggggctcaggctcagccctgagtgcccagtccactgaggccctggaagggctaagtgggcggggacccaaggctggtgggcgacaggatgaggcaggcaccccccgacgagggctgggtgcccgcctccaacagctgctcactccttcccgccactcccctgcctcccgcattcccccacctgagctgcctcctgacctgccacccccagcccgccgcagccccatggacagtcttctgcacccccgggagcgccctggatccactgcctccgagagctcagcctctctgggcagtgagtgggacctctcagaatcttctctcagcaacctgagtcttcgccgttcctcagagcgcctcagtgacacccctggatccttccagtcaccttccctggaaattctgctgtccagctgctccctgtgccgtgcctgtgattcgctggtgtatgatgaggaaatcatggctggctgggcacctgatgactctaacctcaacacaacctgccccttctgcgcctgcccctttgtgcccctgctcagtgtccagacccttgattcccggcccagtgtccccagccccaaatctgctggtgccagtggcagcaaagatgctcctgtccctggtggtcctggccctgtgctcagtgaccgaaggctctgccttgctctggatgagccccagctctgcaacgggcacatggggggagcctcccggcgggttgagagtggggcatgggcatacctgagccccctggtgctgcgtaaggagctggagtcgctggtagagaacgagggcagtgaggtgctggcgttgcctgaactgccctctgcccaccccatcatcttctggaaccttttgtggtatttccaacggctacgcctgcccagtattctaccaggcctggtgctggcctcctgtgatgggccttcgcactcccaggccccatctccttggctaacccctgatccagcctctgttcaggccagatcccccagcgggtggtatggccaggccctgtacctgcatcccttagtttggcactgttggagtcagtgctgcgccatgttggactcaatgaagtgcacaaggctgtggggctcctgctggaaactctagggcccccacccactggcctgcacctgcagaggggaatctaccgtgagatattattcctgacaatggctgctctgggcaaggaccacgtggacatagtggccttcgataagaagtacaagtctgcctttaacaagctggccagcagcatgggcaaggaggagctgaggcaccggcgggcgcagatgcccactcccaaggccattgactgccgaaaatgttttggagcacctccagaatgctagagaccttaagcttccctctccagcctagggtggggaagtgaggaagaagggattctagagttaaactgcttccctgttgccttcatggagttgggaacaggctgggaaggatgcccagtcaaaggctccaagcgaggacaacaggaagagggatccactgttaccaaaagtcctgattcccccatcaccaacctacccagtttgttcgtgctgatgttgggggagatctggggggagttggtacagctctgttcttcccttgtcctataccgggaactcccctccagggtacccacagatctgcattgccctggtcattttagaagtttttgttttaaaaaacaactggaaagatgcagagctactgagcctttgccctgaatgggaggtagggatgtcattctccaccaataatggtccctcttccctgacgttgctgaaggagcccaaggctctccatgcctttctacctaagtgtttgtattttattttaaattatttattctggagccacagcccccttgcttatgaggttcttatggagagtgagaaagggaagggaaatagggcaccatggtccggtggtttgtagttccttcaaagtcaggcactgggagctagaggagtctcaagctccccttaggaagaactggtgccccctccagtcctaatttttcttgcctgccccgccttggggaatgcctcacccacccaggtcctgacctgtgcaataaggattgttccctgcgaagttttgttggatgtaaatatagtaaaagctgcttctgtcttt

SEQ ID NO: 361250 - DNA, 5004 bp, Homo sapiens
cgccggccgaggaggaggggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacaggcagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcaggtgagtggcccctttatccctccaatcctgtgaccctacatccctttgccctggtgcctcttggcaggcaccttaagtgtccccagagtttactttctctttgctactcgggccttctctgggatcccttggttcatttcccttggagtctgatggaccctgctccttttgggtacccccaactatgctgggggtgcagagctgctgggccgctacccggaggaggacaatgaggcgttcccgctgcccgagtcagtgcccgtcttctgcctgcccatgggggccactatcgagtgctggcctgcccagaccaagtaccccgtgcccgtcttctccacctttgtgctcacgggtgcagctggtgataaggtgtatggtgccgccctgcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgccttcctcaccttcctttaccgctactccgtctcaggcccccaccgcctacccttggaagcgcacatctcccacttcattcacaacgttcccttcccttccccacagagaccccgcatcctagtgcagatgtctccctatgacaacttgctcctctgtcagcctgtatcctcacccctgcccctcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcgatgatcttcccactgcactggcagtgcccctacattcctctgtgcccgctggtgctggcagatgtgctgagtgccccagtgcccttcattgtgggtatccactccagctactttgatctgcatgacccgcctgctgatgtcatctgtgtagaccttgataccaacacgctcttccagactgaggaaaagaagctcctctcccctcggaccctgccccgcagaccctacaaggttctgctggccacactgacaaacctgtaccagcagctggaccagacatacactggacctgaggaggaagcatccctggagttcctactgacagactacgaggcagtgtgtggccgcagggcccggctggagcgcgaagtccaaggagccttcctccgcttcatggcctgtctgctcaagggctaccgggtcttcctgcgcccactcacccaggccccctccgagggagctcgtgatgttgacaaccttttcttcctgcagggcttcctcaaatcccgggaacgctccagccacaaactttactctcagctgctgcacacacagatgttctcacagttcattgaggagtgctcttttggctctgctcgccatgctgcccttgaattctttgactcttgtgttgaaaaggtccacccagagcaggagaagcctgagccgacacccttagtggagctagaggagctgtcaggaagtgagctcactgtctttatcacacctcccgaggagcctgccttaccagagggcagtgaatccactccccagtactgctatgatggattcccagagctacgggctgagttgtttgagtctcttcaagagcaacctggggccctgcctgtgccaggcccttcccgtagcgcccccagcagtcctgctcctcgccgtaccaaacaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtgtgttaccgggtactgatgcagctctgctcacactatgggcagcctgtgctgtctgtgcgggtcatgctggagatgcgtcaggcaggcattgtgcccaacaccatcacctatggctactacaataaggctgtgttggaaagcaagtggccgtctggcacaccaggtgggcgtctgcgctgggccaagctccggaatgttgtcctgggggctgctcagttccgccagcccttgagagaacggcaacagcagcagcagcagcagcaacagcagcagcagcagcagcagcagcaggagcaggtgtcagcacatcaagaggcaggcagctcccaggcagagccctatttggagcgcccttcccctactcgccctcttcagcgccagactacttgggctgggcgaagtctgagagacccagcctcaccccctggacgcctggtgaagagtggtagcctgggcagtgcccgaggggcacagcccactgtggaggccggtgtggcccacatgatagaggccttgggggtcctggaaccccggggatcacctgtgccctggcacgatggaagtctctcagacctgagcctgacaggggaggagccgctccctggaggcagcccagggggctcaggctcagccctgagtgcccagtccactgaggccctggaagggctaagtgggcggggacccaaggctggtgggcgacaggatgaggcaggcaccccccgacgagggctgggtgcccgcctccaacagctgctcactccttcccgccactcccctgcctcccgcattcccccacctgagctgcctcctgacctgccacccccagcccgccgcagccccatggacagtcttctgcacccccgggagcgccctggatccactgcctccgagagctcagcctctctgggcagtgagtgggacctctcagaatcttctctcagcaacctgagtcttcgccgttcctcagagcgcctcagtgacacccctggatccttccagtcaccttccctggaaattctgctgtccagctgctccctgtgccgtgcctgtgattcgctggtgtatgatgaggaaatcatggctggctgggcacctgatgactctaacctcaacacaacctgccccttctgcgcctgcccctttgtgcccctgctcagtgtccagacccttgattcccggcccagtgtccccagccccaaatctgctggtgccagtggcagcaaagatgctcctgtccctggtggtcctggccctgtgctcagtgaccgaaggctctgccttgctctggatgagccccagctctgcaacgggcacatggggggagcctcccggcgggttgagagtggggcatgggcatacctgagccccctggtgctgcgtaaggagctggagtcgctggtagagaacgagggcagtgaggtgctggcgttgcctgaactgccctctgcccaccccatcatcttctggaaccttttgtggtatttccaacggctacgcctgcccagtattctaccaggcctggtgctggcctcctgtgatgggccttcgcactcccaggtcagtgcccccatgtggcccctgtttcctaagtgcctccctcatctctcagccatttgtccactgtgtccttggcactgtagaaagagcatagactggccaggcacggtggctcatgcctgtaatcccagcactttgggaggccgaggtgggcgaatcacctgaggtcaggagttcgagaccagcctgaccaactgggagaaaccctgtctctactaaaaatacaaaaaaaattagccaggcttggtggtgcatgcctgtaatcccagctactcgggaggctgaggtgggagaattgcttgaacctgggaggcggaggttgtggtgagccgagatcgcgccattgccctccagcctgagcaacaagagcaaaactccgtctc

SEQ ID NO: 361251 - DNA, 4355 bp, Homo sapiens
cgccggccgaggaggaggggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacaggcagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcaggtgagtggcccctttatccctccaatcctgtgaccctacatccctttgccctggtgcctcttggcaggcaccttaagtgtccccagagtttactttctctttgctactcgggccttctctgggatcccttggttcatttcccttggagtctgatggaccctgctccttttgggtacccccaactatgctgggggtgcagagctgctgggccgctacccggaggaggacaatgaggcgttcccgctgcccgagtcagtgcccgtcttctgcctgcccatgggggccactatcgagtgctggcctgcccagaccaagtaccccgtgcccgtcttctccacctttgtgctcacgggtgcagctggtgataaggtgtatggtgccgccctgcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgccttcctcaccttcctttaccgctactccgtctcaggcccccaccgcctacccttggaagcgcacatctcccacttcattcacaacgttcccttcccttccccacagagaccccgcatcctagtgcagatgtctccctatgacaacttgctcctctgtcagcctgtatcctcacccctgcccctcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcgatgatcttcccactgcactggcagtgcccctacattcctctgtgcccgctggtgctggcagatgtgctgagtgccccagtgcccttcattgtgggtatccactccagctactttgatctgcatgacccgcctgctgatgtcatctgtgtagaccttgataccaacacgctcttccagactgaggaaaagaagctcctctcccctcggaccctgccccgcagaccctacaaggttctgctggccacactgacaaacctgtaccagcagctggaccagacatacactggacctgaggaggaagcatccctggagttcctactgacagactacgaggcagtgtgtggccgcagggcccggctggagcgcgaagtccaaggagccttcctccgcttcatggcctgtctgctcaagggctaccgggtcttcctgcgcccactcacccaggccccctccgagggagctcgtgatgttgacaaccttttcttcctgcagggcttcctcaaatcccgggaacgctccagccacaaactttactctcagctgctgcacacacagatgttctcacagttcattgaggagtgctcttttggctctgctcgccatgctgcccttgaattctttgactcttgtgttgaaaaggtccacccagagcaggagaagcctgagccgacacccttagtggagctagaggagctgtcaggaagtgagctcactgtctttatcacacctcccgaggagcctgccttaccagagggcagtgaatccactccccagtactgctatgatggattcccagagctacgggctgagttgtttgagtctcttcaagagcaacctggggccctgcctgtgccaggcccttcccgtagcgcccccagcagtcctgctcctcgccgtaccaaacaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtgtgttaccgggtactgatgcagctctgctcacactatgggcagcctgtgctgtctgtgcgggtcatgctggagatgcgtcaggcaggcattgtgcccaacaccatcacctatggctactacaataaggctgtgttggaaagcaagtggccgtctggcacaccaggtgggcgtctgcgctgggccaagctccggaatgttgtcctgggggctgctcagttccgccagcccttgagagaacggcaacagcagcagcagcagcagcaacagcagcagcagcagcagcagcagcaggagcaggtgtcagcacatcaagaggcaggcagctcccaggcagagccctatttggagcgcccttcccctactcgccctcttcagcgccagactacttgggctgggcgaagtctgagagacccagcctcaccccctggacgcctggtgaagagtggtagcctgggcagtgcccgaggggcacagcccactgtggaggccggtgtggcccacatgatagaggccttgggggtcctggaaccccggggatcacctgtgccctggcacgatggaagtctctcagacctgagcctgacaggggaggagccgctccctggaggcagcccagggggctcaggctcagccctgagtgcccagtccactgaggccctggaagggctaagtgggcggggacccaaggctggtgggcgacaggatgaggcaggcaccccccgacgagggctgggtgcccgcctccaacagctgctcactccttcccgccactcccctgcctcccgcattcccccacctgagctgcctcctgacctgccacccccagcccgccgcagccccatggacagtcttctgcacccccgggagcgccctggatccactgcctccgagagctcagcctctctgggcagtgagtgggacctctcagaatcttctctcagcaacctgagtcttcgccgttcctcagagcgcctcagtgacacccctggatccttccagtcaccttccctggaaattctgctgtccagctgctccctgtgccgtgcctgtgattcgctggtgtatgatgaggaagtccggtggtttgtagttccttcaaagtcaggcactgggagctagaggagtctcaagctccccttaggaagaactggtgccccctccagtcctaatttttcttgcctgccccgccttggggaatgcctcacccacccaggtcctgacctgtgcaataaggattgttccctgcgaagttttgttggatgtaaatatagtaaaagctgcttctgtcttt

SEQ ID NO: 361252 - DNA, 2843 bp, Homo sapiens
cgccggccgaggaggaggggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacaggcagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcagagctgctgggccgctacccggaggaggacaatgaggcgttcccgctgcccgagtcagtgcccgtcttctgcctgcccatgggggccactatcgagtgctggcctgcccagaccaagtaccccgtgcccgtcttctccacctttgtgctcacgggtgcagctggtgataaggtgtatggtgccgccctgcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgccttcctcaccttcctttaccgctactccgtctcaggcccccaccgcctacccttggaagcgcacatctcccacttcattcacaacgttcccttcccttccccacagagaccccgcatcctagtgcagatgtctccctatgacaacttgctcctctgtcagcctgtatcctcacccctgcccctcaggtatgtgatcagattgtggggaggggagcctttaatgaccaaggacatggtaggtgctgggcaggtgggtgcagctgttgaggtttatgcaggctgggtccaggtggtggctgtgcctggcatctggggaagggtccccagggtatcctggtgaccctttccccacctcggcattgcctgcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcggtgagtgccgccccgcctggcccatcttccccagaaccatggttctttctggtgcccctatccctgcctggactcttcccttttccttccttgtggaggatcctcagcccctttccctgggcacagcctgcaggaacacatagcttccatcaggagctcttctctagagcctacttccaacagcctctctcaacaggcaccaactccccaaggccaatgccctctctttctctctcctgtgcctcccactgctgcctcaaccccctgttcactggttctcactgcctggtgcttcagatgatcttcccactgcactggcagtgcccctacattcctctgtgcccgctggtgctggcagatgtgctgagtgccccagtgcccttcattgtgggtatccactccagctactttgatctgcatgacccgcctgctgatgtcatctgtgtagaccttgataccaacacgctcttccagactgaggaaaagaagctcctctcccctcggaccctgccccgcagaccctacaaggttctgctggccacactgacaaacctgtaccagcagctggaccagaccatgcctttctacctaagtgtttgtattttattttaaattatttattctggagccacagcccccttgcttatgaggttcttatggagagtgagaaagggaagggaaatagggcaccatggtccggtggtttgtagttccttcaaagtcaggcactgggagctagaggagtctcaagctccccttaggaagaactggtgccccctccagtcctaatttttcttgcctgccccgccttggggaatgcctcacccacccaggtcctgacctgtgcaataaggattgttccctgcgaagttttgttggatgtaaatatagtaaaagctgcttctgtcttt

SEQ ID NO: 361253 - DNA, 1718 bp, Homo sapiens
cgccggccgaggaggaggggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacaggcagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcaggtgagtggcccctttatccctccaatcctgtgaccctacatccctttgccctggtgcctcttggcaggcaccttaagtgtccccagagtttactttctctttgctactcgggccttctctgggatcccttggttcatttcccttggagtctgatggaccctgctccttttgggtacccccaactatgctgggggtgcagagctgctgggccgctacccggaggaggacaatgaggcgttcccgctgcccgagtcagtgcccgtcttctgcctgcccatgggggccactatcgagtgctggcctgcccagaccaagtaccccgtgcccgtcttctccacctttgtgctcacgggtgcagctggtgataaggtgtatggtgccgccctgcagttctacgaggcgttcccaagggccaggctatcagagcgacaggcacgggtccggtggtttgtagttccttcaaagtcaggcactgggagctagaggagtctcaagctccccttaggaagaactggtgccccctccagtcctaatttttcttgcctgccccgccttggggaatgcctcacccacccaggtcctgacctgtgcaataaggattgttccctgcgaagttttgttggatgtaaatatagtaaaagctgcttctgtcttt

SEQ ID NO: 361254 - DNA, 332 bp, Homo sapiens
ccagccccaaatctgctggtgccagtggcagcaaagatgctcctgtccctggtggtcctggccctgtgctcagtgaccgaaggctctgccttgctctggatgagccccagctctgcaacgggcacatgggggtaagggctgggccaaaggggcatgaggaacgggaatgttgccctgtgtggggcctgtggggtgccagggagagatgggcacatctcttgcccttgagggcaaggggcatcccaaaagctgttggatgtggtggctcagtgggaggcaaggctctggggatgtacatgccctctactgccctccccctttgtgcctgatag

SEQ ID NO: 361255 - DNA, 1137 bp, Homo sapiens
ctgcaagaaaatgcacatgctatataatataatgtaaatatatacacatacaactcatttgatctcacttatgtaaaaatatgcattcctaataatggcttatcctactgagtgacttattaaatgtcacaacaacgttttaaagtaggtactcttacctccattttgcagatagaggttaggtaattttcccaaggtcacacagctagtaaaggacagagttcatatttgaaacccagtctgtcaggctctatagcccctactcttaatcactatattatgcagggagaaatccatcaacatattgtctttgggtggtggtttattttcttctttattctctaggattttctatttggatatactctaggagttaaatgataaacttttgaatagggaagaaggtggggtggtgaaatttgaaggccaaacatgtgctttcaaacaaaagaattcactccatttccttttccacttttctacattttccagaagaactgatgaccaccccaattttacagcccactgaggccctgtccccagaagatggagccagcacagcactcattgcaggtaatagactctgagccaactccaagggaccttctggatcaagggcatctctctccagagggagcctgaccaaatccattaatgggctcactctggcttgtaagttatattacacacacacacacacacacacacacacacacacagccataaaagactcggaggcttctgtcagaggcactaccagtaaatgacaggttgggaggtggccgcaaatagatatgcatacggacgttacacttgagtacgtgggtagggacgaggatatatgtggttggttgagtgggtgaggaagagggggaggatcagataaaccacttcctgttaggataagccatttcctgttccctccttcccgtttctttaagaatcaggaactggtttgggaggcagttcagttttgtcagaaatcaaaagcatgtgtccttagcttaagcaccaggagactccagctattatgtgccatggaaattggggttggtgggggaacatgggtttggatggaagtggacactagttaatgaaaacaagaggatctttacgaaaacagtgactaaatcagat

SEQ ID NO: 361256 - DNA, 1094 bp, Homo sapiens
gccggagagccgggtcgcccacattcgccgcagccacctcggccgtggcaggaaccgaaacccggagcggccgaagctcagcgctccgctggggcagagggtcgcggcggctgggaacgccgctccccgacgcaccggccgcccccagcgcagcgcgctccgcggggtgctgatctgcctcttctccaagaaactcaaccactagtgacaatgaccagcctcctgactactccttctccaagagaagaactgatgaccaccccaattttacagcccactgaggccctgtccccagaagatggagccagcacagcactcattgcagttgttatcaccgttgtcttcctcaccctgctctcggtcgtgatcttgatcttcttttacctgtacaagaacaaaggcagctacgtcacctatgaacctacagaaggtgagcccagtgccatcgtccagatggagagtgacttggccaagggcagcgagaaagaggaatatttcatctaatgactcccaggccccaaggagcttattcctggctccatcgctaacacgttgactgcttattatgggaaagttttctctgaagccagggagaagcattgattgatgtgggcaaatccaagctccagccaggtcgcagtcccaaatgccgacatcactgactccagggaccagggacatggagaaagctgtttatgatatctttaaccaggccctcttactagagctggtgtttgtgactggccaacaagatgtggctatgccaggggacatctgagtatgtgcccagtcatcttttttcacaggttgaagggagagaaaagattttgagttaaggtcattggctgctctactctgtcccctacctggtcacctagtgatagccccagtggagatactgtccatacaaggtcttcccagaggctggataccacagtaaaaggccaggccaggaggggtaggagactatggagatcttacctcctgataaatgtgctacaccccctaatctgagcccttcctttccgtgttccccaacaacctcatgcttacgtgatttttattcaaattaaaaattttcattgctacagaaa

SEQ ID NO: 361257 - DNA, 217 bp, Homo sapiens
gaggatacggaagactctggtggtgatctgcctcttctccaagaaactcaaccactagtgacaatgaccagcctcctgactactccttctccaagagaagaactgatgaccaccccaattttacagcccactgaggccctgtccccagaagatggagccagcacagcactcattgcagttgtatcaccaccaggattctgggatcctctagatcacc

SEQ ID NO: 361258 - DNA, 1703 bp, Homo sapiens
gcccgcgttcgcaggggcgtcgaggatctccggggcgcggggcgcgggctggggcccagtgaggcttggcaggctgtgcgcggaccgcgccctggacggcgaaagcaggcccggagggggcggccagtccggcgtcccagcgtccgaggcgagccagaaggcggcccacggccgtcgcctcccggtcccggcccggctactgcgctgcgcccactccgctctggagcctgggcgcgggtcctgaccttcccggccctctcctgacacctggtggatggcgtcaccagaactcctagctgtggaaccctagggtacctgttaccgcgctttggcgaaactgggttcgctgctgatttgcgaacctttgcctgactttctcaggccttgagagatctaagtaaatttggtggcccattgaaaggacctggagagagcgtatgaaggtaacaccccgtcaaactgcatgcggcctcagacctgctcctgtggagagctgttggtacctggagcctgaggagatattcagggaaaccagaagaggacaagaggaaaaggggaagggacttgggagaacctggcaccagaggctttcctgggacttccaggactcaaagccataggggcccacccgctacattcctgtctttgcccctcttcctacaatctgcctcttctccaagaaactcaaccactagtgacaatgaccagcctcctgactactccttctccaagagggtctcactctgtcacccagactagagtacagtggcacaatcacagctcactgcagcctggacctcctgggctccagtgatcctctcacctcaagtttaccgagtagctgggactacagaagaactgatgaccaccccaattttacagcccactgaggccctgtccccagaagatggagccagcacagcactcattgcagttgttatcaccgttgtcttcctcaccctgctctcggtcgtgatcttgatcttcttttacctgtacaagaacaaaggcagctacgtcacctatgaacctacagaaggtgagcccagtgccatcgtccagatggagagtgacttggccaagggcagcgagaaagaggaatatttcatctaatgactcccaggccccaaggagcttattcctggctccatcgctaacacgttgactgcttattatgggaaagttttctctgaagccagggagaagcattgattgatgtgggcaaatccaagctccagccaggtcgcagtcccaaatgccgacatcactgactccagggaccagggacatggagaaagctgtttatgatatctttaaccaggccctcttactagagctggtgtttgtgactggccaacaagatgtggctatgccaggggacatctgagtatgtgcccagtcatcttttttcacaggttgaagggagagaaaagattttgagttaaggtcattggctgctctactctgtcccctacctggtcacctagtgatagccccagtggagatactgtccatacaaggtcttcccagaggctggataccacagtaaaaggccaggccaggaggggtaggagactatggagatcttacctcctgataaatgtgctacaccccctaatctgagcccttcctttccgtgttccccaacaacctcatgcttacgtgatttttattcaaattaaaaattttcattgctacagaaa

SEQ ID NO: 361259 - DNA, 1342 bp, Homo sapiens
ctgcaagaaaatgcacatgctatataatataatgtaaatatatacacatacaactcatttgatctcacttatgtaaaaatatgcattcctaataatggcttatcctactgagtgacttattaaatgtcacaacaacgttttaaagtaggtactcttacctccattttgcagatagaggttaggtaattttcccaaggtcacacagctagtaaaggacagagttcatatttgaaacccagtctgtcaggctctatagcccctactcttaatcactatattatgcagggagaaatccatcaacatattgtctttgggtggtggtttattttcttctttattctctaggattttctatttggatatactctaggagttaaatgataaacttttgaatagggaagaaggtggggtggtgaaatttgaaggccaaacatgtgctttcaaacaaaagaattcactccatttccttttccacttttctacattttccagaagaactgatgaccaccccaattttacagcccactgaggccctgtccccagaagatggagccagcacagcactcattgcagttgttatcaccgttgtcttcctcaccctgctctcggtcgtgatcttgatcttcttttacctgtacaagaacaaaggcagctacgtcacctatgaacctacagaaggtgagcccagtgccatcgtccagatggagagtgacttggccaagggcagcgagaaagaggaatatttcatctaatgactcccaggccccaaggagcttattcctggctccatcgctaacacgttgactgcttattatgggaaagttttctctgaagccagggagaagcattgattgatgtgggcaaatccaagctccagccaggtcgcagtcccaaatgccgacatcactgactccagggaccagggacatggagaaagctgtttatgatatctttaaccaggccctcttactagagctggtgtttgtgactggccaacaagatgtggctatgccaggggacatctgagtatgtgcccagtcatcttttttcacaggttgaagggagagaaaagattttgagttaaggtcattggctgctctactctgtcccctacctggtcacctagtgatagccccagtggagatactgtccatacaaggtcttcccagaggctggataccacagtaaaaggccaggccaggaggggtaggagactatggagatcttacctcctgataaatgtgctacaccccctaatctgagcccttcctttccgtgttccccaacaacctcatgcttacgtgatttttattcaaattaaaaattttcattgctacagaaa

SEQ ID NO: 361260 - DNA, 1492 bp, Homo sapiens
gcgcgccacccgcggcttcctccgctcggggtcctcgctcggcctctgctggcctccgcgactccgcggtgcccgcccccgttgagttcaaaaggacgcgcggagcggcgccggcccttcaccagcagcccgtccgactggaaagatctgcctcttctccaagaaactcaaccactagtgacaatgaccagcctcctgactactccttctccaagagaagaactgatgaccaccccaattttacagcccactgaggccctgtccccagaagatggagccagcacagcactcattgcagttgttatcaccgttgtcttcctcaccctgctctcggtcgtgatcttgatcttcttttacctgtacaagaacaaaggcagctacgtcacctatgaacctacagaaggtgagcccagtgccatcgtccagatggagagtgacttggccaagggcagcgagaaagaggaatatttcatctaatgactcccaggccccaaggagcttattcctggctccatcgctaacacgttgactgcttattatgggaaagttttctctgaagccagggagaagcattgattgatgtgggcaaatccaagctccagccaggtcgcagtcccaaatgccgacatcactgactccagggaccagggacatggagaaagctgtttatgatatctttaaccaggccctcttactagagctggtgtttgtgactggccaacaagatgtggctatgccaggggacatctgagtatgtgcccagtcatcttttttcacaggttgaagggagagaaaagattttgagttaaggtcattggctgctctactctgtcccctacctggtcacctagtgatagccccagtggagatactgtccatacaaggtcttcccagaggctggataccacagtaaaaggccaggccaggaggggtaggagactatggagatcttacctcctgataaatgtgctacaccccctaatctgagcccttcctttccgtgttccccaacaacctcatgcttacgtgatttttattcaaattaaaaattttcattgctacagaaaaaaaaaaaaaaaattttccttaaatttttatactagcattttaccatctcaccttctaggaatactagtatatcggtcacacctaatatcctccttattatgcctaaaaggaataatactatcgctgtcataattagctattctgaatagcccttaaaaaaccattccctttttaagcaaatattggtgcctattgcatatagtctttgccgctggaaaaggggggctagcctaatagtctcaatctccaaccatatggctaaataataatactaaactatcatgtaaatatcgccacatattatacgtggatgcttccaaaccttttgtcaccacccagtatttgttcctttttttacctacactttgtgcgttgcgcaccacaacttaaaaaactggcgccccggttttttctccacaacaag

SEQ ID NO: 361261 - DNA, 854 bp, Homo sapiens
gcccgcgttcgcaggggcgtcgaggatctccggggcgcggggcgcgggctggggcccagtgaggcttggcaggctgtgcgcggaccgcgccctggacggcgaaagcaggcccggagggggcggccagtccggcgtcccagcgtccgaggcgagccagaaggcggcccacggccgtcgcctcccggtcccggcccggctactgcgctgcgcccactccgctctggagcctgggcgcgggtcctgaccttcccggccctctcctgacacctggtggatggcgtcaccagaactcctagctgtggaaccctagggtacctgttaccgcgctttggcgaaactgggttcgctgctgatttgcgaacctttgcctgactttctcaggccttgagagatctaagtaaatttggtggcccattgaaaggacctggagagagcgtatgaaggtaacaccccgtcaaactgcatgcggcctcagacctgctcctgtggagagctgttggtacctggagcctgaggagatattcagggaaaccagaagaggacaagaggaaaaggggaagggacttgggagaacctggcaccagaggctttcctgggacttccaggactcaaagccataggggcccacccgctacattcctgtctttgcccctcttcctacaatctgcctcttctccaagaaactcaaccactagtgacaatgaccagcctcctgactactccttctccaagagaagaactgatgaccaccccaattttacagcccactgaggccctgtccccagaagatggagccagcacagcactcattgcagttgtatcaccaccaggattctgggatcctctagatcacc

SEQ ID NO: 361262 - DNA, 1067 bp, Homo sapiens
gcgcgccacccgcggcttcctccgctcggggtcctcgctcggcctctgctggcctccgcgactccgcggtgcccgcccccgttgagttcaaaaggacgcgcggagcggcgccggcccttcaccagcagcccgtccgactggaaagatctgcctcttctccaagaaactcaaccactagtgacaatgaccagcctcctgactactccttctccaagagaagaactgatgaccaccccaattttacagcccactgaggccctgtccccagaagatggagccagcacagcactcattgcagttgttatcaccgttgtcttcctcaccctgctctcggtcgtgatcttgatcttcttttacctgtacaagaacaaaggcagctacgtcacctatgaacctacagaaggtgagcccagtgccatcgtccagatggagagtgacttggccaagggcagcgagaaagaggaatatttcatctaatgactcccaggccccaaggagcttattcctggctccatcgctaacacgttgactgcttattatgggaaagttttctctgaagccagggagaagcattgattgatgtgggcaaatccaagctccagccaggtcgcagtcccaaatgccgacatcactgactccagggaccagggacatggagaaagctgtttatgatatctttaaccaggccctcttactagagctggtgtttgtgactggccaacaagatgtggctatgccaggggacatctgagtatgtgcccagtcatcttttttcacaggttgaagggagagaaaagattttgagttaaggtcattggctgctctactctgtcccctacctggtcacctagtgatagccccagtggagatactgtccatacaaggtcttcccagaggctggataccacagtaaaaggccaggccaggaggggtaggagactatggagatcttacctcctgataaatgtgctacaccccctaatctgagcccttcctttccgtgttccccaacaacctcatgcttacgtgatttttattcaaattaaaaattttcattgctacagaaa

SEQ ID NO: 361263 - DNA, 1160 bp, Homo sapiens
gcccgcgttcgcaggggcgtcgaggatctccggggcgcggggcgcgggctggggcccagtgaggcttggcaggctgtgcgcggaccgcgccctggacggcgaaagcaggcccggagggggcggccagtccggcgtcccagcgtccgaggcgagccagaaggcggcccacggccgtcgcctcccggtcccggcccggctactgcgctgcgcccactccgctctggagcctgggcgcgggtcctgaccttcccggccctctcctgacacctggtggatggcgtcaccagaactcctagctgtggaaccctagggtacctgttaccgcgctttggcgaaactgggttcgctgctgatttgcgaacctttgcctgactttctcaggccttgagagatctaagtaaatttggtggcccattgaaaggacctggagagagcgtatgaagatctgcctcttctccaagaaactcaaccactagtgacaatgaccagcctcctgactactccttctccaagagaagaactgatgaccaccccaattttacagcccactgaggccctgtccccagaagatggagccagcacagcactcattgcaggtaatagactctgagccaactccaagggaccttctggatcaagggcatctctctccagagggagcctgaccaaatccattaatgggctcactctggcttgtaagttatattacacacacacacacacacacacacacacacacacagccataaaagactcggaggcttctgtcagaggcactaccagtaaatgacaggttgggaggtggccgcaaatagatatgcatacggacgttacacttgagtacgtgggtagggacgaggatatatgtggttggttgagtgggtgaggaagagggggaggatcagataaaccacttcctgttaggataagccatttcctgttccctccttcccgtttctttaagaatcaggaactggtttgggaggcagttcagttttgtcagaaatcaaaagcatgtgtccttagcttaagcaccaggagactccagctattatgtgccatggaaattggggttggtgggggaacatgggtttggatggaagtggacactagttaatgaaaacaagaggatctttacgaaaacagtgactaaatcagat

SEQ ID NO: 361264 - DNA, 1584 bp, Homo sapiens
gcccgcgttcgcaggggcgtcgaggatctccggggcgcggggcgcgggctggggcccagtgaggcttggcaggctgtgcgcggaccgcgccctggacggcgaaagcaggcccggagggggcggccagtccggcgtcccagcgtccgaggcgagccagaaggcggcccacggccgtcgcctcccggtcccggcccggctactgcgctgcgcccactccgctctggagcctgggcgcgggtcctgaccttcccggccctctcctgacacctggtggatggcgtcaccagaactcctagctgtggaaccctagggtacctgttaccgcgctttggcgaaactgggttcgctgctgatttgcgaacctttgcctgactttctcaggccttgagagatctaagtaaatttggtggcccattgaaaggacctggagagagcgtatgaaggtaacaccccgtcaaactgcatgcggcctcagacctgctcctgtggagagctgttggtacctggagcctgaggagatattcagggaaaccagaagaggacaagaggaaaaggggaagggacttgggagaacctggcaccagaggctttcctgggacttccaggactcaaagccataggggcccacccgctacattcctgtctttgcccctcttcctacaatctgcctcttctccaagaaactcaaccactagtgacaatgaccagcctcctgactactccttctccaagagaagaactgatgaccaccccaattttacagcccactgaggccctgtccccagaagatggagccagcacagcactcattgcagttgttatcaccgttgtcttcctcaccctgctctcggtcgtgatcttgatcttcttttacctgtacaagaacaaaggcagctacgtcacctatgaacctacagaaggtgagcccagtgccatcgtccagatggagagtgacttggccaagggcagcgagaaagaggaatatttcatctaatgactcccaggccccaaggagcttattcctggctccatcgctaacacgttgactgcttattatgggaaagttttctctgaagccagggagaagcattgattgatgtgggcaaatccaagctccagccaggtcgcagtcccaaatgccgacatcactgactccagggaccagggacatggagaaagctgtttatgatatctttaaccaggccctcttactagagctggtgtttgtgactggccaacaagatgtggctatgccaggggacatctgagtatgtgcccagtcatcttttttcacaggttgaagggagagaaaagattttgagttaaggtcattggctgctctactctgtcccctacctggtcacctagtgatagccccagtggagatactgtccatacaaggtcttcccagaggctggataccacagtaaaaggccaggccaggaggggtaggagactatggagatcttacctcctgataaatgtgctacaccccctaatctgagcccttcctttccgtgttccccaacaacctcatgcttacgtgatttttattcaaattaaaaattttcattgctacagaaa

SEQ ID NO: 361265 - DNA, 1379 bp, Homo sapiens
gcccgcgttcgcaggggcgtcgaggatctccggggcgcggggcgcgggctggggcccagtgaggcttggcaggctgtgcgcggaccgcgccctggacggcgaaagcaggcccggagggggcggccagtccggcgtcccagcgtccgaggcgagccagaaggcggcccacggccgtcgcctcccggtcccggcccggctactgcgctgcgcccactccgctctggagcctgggcgcgggtcctgaccttcccggccctctcctgacacctggtggatggcgtcaccagaactcctagctgtggaaccctagggtacctgttaccgcgctttggcgaaactgggttcgctgctgatttgcgaacctttgcctgactttctcaggccttgagagatctaagtaaatttggtggcccattgaaaggacctggagagagcgtatgaaggtaacaccccgtcaaactgcatgcggcctcagacctgctcctgtggagagctgttggtacctggagcctgaggagatattcagggaaaccagaagaggacaagaggaaaaggggaagggacttgggagaacctggcaccagaggctttcctgggacttccaggactcaaagccataggggcccacccgctacattcctgtctttgcccctcttcctacaatctgcctcttctccaagaaactcaaccactagtgacaatgaccagcctcctgactactccttctccaagagaagaactgatgaccaccccaattttacagcccactgaggccctgtccccagaagatggagccagcacagcactcattgcaggtaatagactctgagccaactccaagggaccttctggatcaagggcatctctctccagagggagcctgaccaaatccattaatgggctcactctggcttgtaagttatattacacacacacacacacacacacacacacacacacagccataaaagactcggaggcttctgtcagaggcactaccagtaaatgacaggttgggaggtggccgcaaatagatatgcatacggacgttacacttgagtacgtgggtagggacgaggatatatgtggttggttgagtgggtgaggaagagggggaggatcagataaaccacttcctgttaggataagccatttcctgttccctccttcccgtttctttaagaatcaggaactggtttgggaggcagttcagttttgtcagaaatcaaaagcatgtgtccttagcttaagcaccaggagactccagctattatgtgccatggaaattggggttggtgggggaacatgggtttggatggaagtggacactagttaatgaaaacaagaggatctttacgaaaacagtgactaaatcagat

SEQ ID NO: 361266 - DNA, 1448 bp, Homo sapiens
atttctcacgcttctggaggctggattccaagatcaaggttccaggagactcagtgtctggcaaggtctcggtttctgcctcagagatggtgccatctggctgtgtcctcacaaggaggaaggtgcaagaagctcccctcaggctctgtctgtaagacactgatcccattcatgagggggaaacgtaatgacctaatcagcccccagagaccccacttctaacaccatcaccttggggttgaggatttcaacacttgaatctcagggggacacagacattcagaccacagcaatgactatattaaaatagaaaaaatgtaagttgtattatctcatagattattcaaaatttagacgattgtaaccagaagcatgtgctaaatccttaggtatagaatgtgcagagaaaaataagtttaataatgtgatgaaaattacacagactgttgtggtttctgccagcctccaagacatcagcatgccaagccctaagtggttaatttttatcttaccagcagatacccccaatttctcccttaaagaacataaacgtgaatacttttttcttgtttcaggcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgtttactaagttaatatttcaaaaaaaaa

SEQ ID NO: 361267 - DNA, 2019 bp, Homo sapiens
  misc_feature (48)..(48): n is a, c, g, or t
gggctgtggtgcctgtcgttcgagttcgcatagaggggctgggcgggncacgcggggaacctgccttgagccccgcggggtccacgccggaccagggcggccttgggcctgggcgctccctgagacccccacccccaacaccgtgcttggagccgccgcggggctctgggcttttcgatcttgaggacggggcggttccgaagtccctgagggcgaaggcctgagcgcggcccggcgggcgcgtggtttttgtcccgcgaaacgtacacggcgggtgttttgcgccgcctccttcgtcacctgccgcagtgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgaggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagtaacagaaatgaatataagctctatcctggactttccagctatcatgagagagttggcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgtttactaagttaatatttcaaaaaaaaa

SEQ ID NO: 361268 - DNA, 2120 bp, Homo sapiens
ggcagatctcacgagagaggatttggcgccctcctctgtggattctggccaggccgggttcggcggttgctgtgagagcgggcttcccaacaccatgccgtccgccttctctgtcagctctttccccgtcagcatcccagccgtgctcacgcagacggactggactgagccctggctcatggggctggccaccttccacgcgctctgcgtgctcctcacctgcttgtcctcccgaagctacagactacagatcgggcactttctgtgtctagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactggaatttgattgaagaagtccatgtcatatgtgtaactagtactaattataaatataaaatacacaatataaaatatgaaactcaataataaacagtgccacctgtacatgggcaccatgccctcctcctcgtgctgtgttttctagtgcatgccacagttcgcagtagagggtgttttcaccttccaagacatggggcaaagtttggagacacctggttgtcactggagggggtggtgctcctggcttctcctgtggagcccggggtgatgcataaaatcctgtgtgcctgggtcagccgcatcacagacaatgacttgacatgaaatgtcagctgtgctggggcagagagaccttggaaggaagctcttggaaaatacgttgtatctcagtttgatgaaccaattcacaagaggctaggccctctctagcaaagttatgggctgctttactgaaaacagaatggaagccctgaagtcaacactccatggagaagcgtgtctttcctaatgtcctggtgttctgttgatttaggtgcttgggaacacaatgctcccagttctgttaggacaggcatactgttactttgcaatatccactttataaaatagctcctgcccagtggctcttggttcctgtcaaatgtggacctgtagtttaagaatgacaggtggttagagacccagatatttaaaaataggtgttcaataagggaatactgattgtgcattgtatctggatagcatgcctaattgtgcatttctgaaagttaccaattcaaaatgtaattggaacagttatctttgattagacaagcctgggaagagaatgttgaggtgcagagctcaccagccaagttcatgcccctctcgggcctttgtggctgagaagtgggacagaaagatgattaaggtaatgtgtcctccctgtagcattgtccagggccgttgtgtagatatttgacttcactgacagaaaagaaaccagggagtttgtagagactgtgcatttttagtataacattttcaccatctgatatggtttggctttgtgtccccacccaaattgcatctcaaattgtaatccccatgtgtcaagggagggacctgatgggaggtgatgggatcatgggggtggtttcccctatgttgttatcataatagagagggagttctcacaagatctgctggttttaaagacagcagtttcccctgctgtcactgtctctctcctgctgccttgtgaagaaggtgcttgtttctccctctgccatgattgtaagtttcccgaggcctccccggccatgtggaactgagtcaattaaacttcttgtttataaagt

SEQ ID NO: 361269 - DNA, 1725 bp, Homo sapiens
  misc_feature (24)..(24): n is a, c, g, or t
agcaggctggtacaggcccgagangtaagatgggcagcctcgggacggggcgccgcggccgggcgggcagcatgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgaggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgtttactaagttaatatttcaaaaaaaaa

SEQ ID NO: 361270 - DNA, 1795 bp, Homo sapiens
cgcaccaacgccaacagggcagcgcgtgtgagagccacgcctgcgcaatcggctccagtgcgcctgcggaggcggtcctatgacgtgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgaggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagtaacagaaatgaatataagctctatcctggactttccagctatcatgagagagttggcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgtttactaagttaatatttcaaaaaaaaa

SEQ ID NO: 361271 - DNA, 1861 bp, Homo sapiens
ggcagatctcacgagagaggatttggcgccctcctctgtggattctggccaggccgggttcggcggttgctgtgagagcgggcttcccaacaccatgccgtccgccttctctgtcagctctttccccgtcagcatcccagccgtgctcacgtgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgaggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagtaacagaaatgaatataagctctatcctggactttccagctatcatgagagagttggcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgtttactaagttaatatttcaaaaaaaaa

SEQ ID NO: 361272 - DNA, 1769 bp, Homo sapiens
tggaggggaaggagccgcgggagtgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgagacacatttacagctacatattccctctgagcattgccctggctgccttccataagtgtggagtgccactccagctttcttaggttgccatctgcatgacacatctttctccatccttttactgtcaatctaatggtatcagacttggtgataattctgaattatgaccgtgctgtagaagcttttgcaaaaggcggaaatctgaccgaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgtttactaagttaatatttcaaaaaaaaa

SEQ ID NO: 361273 - DNA, 1678 bp, Homo sapiens
ccccactaaaccttaggatcaccacctacatgaccaggttgtgtggaagattgaaggacatgatgcaggtaaacctcatagtatacacatggtgcacagtaaatgctcgctgaggtttgttgtaattacctgtggcaatattggcttcataattcatcagctcaaaataaaaatatggctcttgtctcacgttctttcctgtctctattgatgttttgctacagtgcatatggtgtagttgagtgttagtcaagatgaattttaaatgatatttagtcttaacgatttttaaatccatgggtttctacactttaggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgtttactaagttaatatttcaaaaaaaaa

SEQ ID NO: 361274 - DNA, 1714 bp, Homo sapiens
agcggagtgtgcctgcggaggcggtcctatgacggaaaactttattctcaagagatttctcattccgcagaaataaggatctggcatgtcaacacaaacataggaagttgaggcagtcaaagggaaataactgctaccctgactctgctgagagcctcacaagtccctgtgcacgccagcttgtttgccatgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgaggtatcagacttggtgataattctgaattatgaccgtgctgtagaagcttttgcaaaaggcggaaatctgaccctcggagggaacttgactgtggcggttgggcccttgggaagattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgtttactaagttaatatttcaaaaaaaaa

SEQ ID NO: 361275 - DNA, 1315 bp, Homo sapiens
tgtaaggtgactctacaggatctataaacggagctgaactccctaagaccttgcacaggtggtcagaggtgcctgggggaggttagcttccaggcatgagaagagcacaccctgtccacatctgagtcttgtcatccagttcaattacatagagtccagaggggtgcatgtgagctttgagagtgccacattaataagcacacatgataaaagtttgctacataacctcattagaaaagagttatatgtgcctaagtaaaaacaagattttaaaattatgtgtatttatctttttgtttctcccaggctaaagaattacctccaaagccattgtcaagaccacagcagtcatctgcaccagtccagctgaactctggctctcaaagtaacagaaatgaatataagctctatcctggactttccagctatcatgagagagttggcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgtttactaagttaatatttcaaaaaaaaa

SEQ ID NO: 361276 - DNA, 790 bp, Homo sapiens
  misc_feature (24)..(24): n is a, c, g, or t
agcaggctggtacaggcccgagangtaagatgggcagcctcgggacggggcgccgcggccgggcgggcagcatgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgaggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaagtcagttcaagttaaagtgattttaattgaaagtgtgatgagaaaatagtacttcaaaagttgatataatttgcagagtacatttatatattctttttacaacatgtggttttaagtgtgtatcttacatttaaaaattaaatatacaaataatatatgctcgtagaaaatgcagaagacacatga

SEQ ID NO: 361277 - DNA, 1666 bp, Homo sapiens
agcggagggactgggccgccgttcacctgcaggggcggggctgcaggaaaactttattctcaagagatttctcattccgcagaaataaggatctggcatgtcaacacaaacataggaagttgaggcagtcaaagggaaataactgctaccctgactctgctgagagcctcacaagtccctgtgcacgccagcttgtttgccagtgagtggcgtcatgataagacaaaattctctgctctgagacctaagcacatgaagtttttaaaaaaattttctctgagaagatcccattttttactctaaaagatcagaccagtgtggcatgtgtggaactgctctgtaccaagatcacactcttcagttggagaagaggaagggcaggaataaataaagggctttcctgtctcccgagggagcagagaaagctttcgctgtcctcttccttccccagccacagcctggggttgggggactggaaacaagctcaggctagcacttgatgttcagacggtagtctgaaagtttgactagggagttaatgatctgaccagagagacaggtttttattttgagaactgacaagctttgtgtccttaaaacaaaggaagtagttaaaccaaggccccagaaaggtaagaattgacttaagaaacaaaggccatagttgtcaagcagtggagttcaaaatgcagttttgttaataaaagtagcttaaagcaacatttgaaagcctctctaaagattagatacatacactttcttttggctaagatttctttagtttattctaaatatacctttagcagcattcaagttcctttgatcttagatggaattttatcagtttaatgagttaacctccatttcacataaagtataaggtttaataatttgattaatatgtaatcagtaagaacttggaaaaccaaatttagtaagcttgctttcctgtaagtattcctttcataattagagtccattgaagaaaataatataagggaagcaaaagtttgggaatctgaactctggtaaggaaagtggtggagaggggcccttgggtcttcttgctttcattcctgaccctccgtgtacaactagattggaaaccgtagtcagctttgtcacctcaggtggcaatttactccgagtaggattctcatgtccctgtttgtccccagtgactctagcattgagtttatagaactgcgatcaatacctaaaattatttccagatcttaagctgatttatgcttttgaggtttccaaagtaaaaattgtctttccggtattttataagaccttctaatttaaaaaaaaaatgtgttactatgaaaatttaaaacattttaacttttgttttaaagaaaactttatttgaaagtttcttagcttgaggtttggcagccactctttttttagaaaaaacttaaatatttatagagattttgcctgattcaagggacttaagacgtttatgagagtgcagatgctaaccatgatgtgaggtttaagaggcttcattagtaatgacctgtgtcttcatcagtatgatagaatgggacatcagcactctgatcaggtcatgctctatatgccttatggtacagcagaggaaaaatgggtgagccatcatttgatgctgaggatgggatttgaggcttatgtc

SEQ ID NO: 361278 - DNA, 2601 bp, Homo sapiens
ggcagatctcacgagagaggatttggcgccctcctctgtggattctggccaggccgggttcggcggttgctgtgagagcgggcttcccaacaccatgccgtccgccttctctgtcagctctttccccgtcagcatcccagccgtgctcacggtacagcagggtcccggggagtccaggaggcggcggagtgcggcactgtctggagagttcactgtattgcagagaggttggagaaaatcaagtcttgcacgtggcgatggctcaagattccctgaggtcttcagtgctgactaaggagtctgaaatgatgattcatgttttacctttggggctgagccaagtgcatctctttgagcaatcgtcttaatttccttgtcgtcaccaattatcataaccaattatcatcgtaaaggatggtaattcctttaattatacccaccttaaaaacatgattctgttccacaaacgaaaggagcacatcagagatgccttcagttctgtgtgcttgaactttgaattccatgaattatagttgcactgaggggagaatcctgtttacatcctcctggttccttctccctttcctgtccccatgtttctctgaggcctggcaatgctctctggatacttgcagacggactggactgagccctggctcatggggctggccaccttccacgcgctctgcgtgctcctcacctgcttgtcctcccgaagctacagactacagatcgggcactttctgtgtctagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactggaatttgattgaagaagtccatgtcatatgtgtaactagtactaattataaatataaaatacacaatataaaatatgaaactcaataataaacagtgccacctgtacatgggcaccatgccctcctcctcgtgctgtgttttctagtgcatgccacagttcgcagtagagggtgttttcaccttccaagacatggggcaaagtttggagacacctggttgtcactggagggggtggtgctcctggcttctcctgtggagcccggggtgatgcataaaatcctgtgtgcctgggtcagccgcatcacagacaatgacttgacatgaaatgtcagctgtgctggggcagagagaccttggaaggaagctcttggaaaatacgttgtatctcagtttgatgaaccaattcacaagaggctaggccctctctagcaaagttatgggctgctttactgaaaacagaatggaagccctgaagtcaacactccatggagaagcgtgtctttcctaatgtcctggtgttctgttgatttaggtgcttgggaacacaatgctcccagttctgttaggacaggcatactgttactttgcaatatccactttataaaatagctcctgcccagtggctcttggttcctgtcaaatgtggacctgtagtttaagaatgacaggtggttagagacccagatatttaaaaataggtgttcaataagggaatactgattgtgcattgtatctggatagcatgcctaattgtgcatttctgaaagttaccaattcaaaatgtaattggaacagttatctttgattagacaagcctgggaagagaatgttgaggtgcagagctcaccagccaagttcatgcccctctcgggcctttgtggctgagaagtgggacagaaagatgattaaggtaatgtgtcctccctgtagcattgtccagggccgttgtgtagatatttgacttcactgacagaaaagaaaccagggagtttgtagagactgtgcatttttagtataacattttcaccatctgatatggtttggctttgtgtccccacccaaattgcatctcaaattgtaatccccatgtgtcaagggagggacctgatgggaggtgatgggatcatgggggtggtttcccctatgttgttatcataatagagagggagttctcacaagatctgctggttttaaagacagcagtttcccctgctgtcactgtctctctcctgctgccttgtgaagaaggtgcttgtttctccctctgccatgattgtaagtttcccgaggcctccccggccatgtggaactgagtcaattaaacttcttgtttataaagt

SEQ ID NO: 361279 - DNA, 1316 bp, Homo sapiens
agcggagggactgggccgccgttcacctgcaggggcggggctgcaggaaaactttattctcaagagatttctcattccgcagaaataaggatctggcatgtcaacacaaacataggaagttgaggcagtcaaagggaaataactgctaccctgactctgctgagagcctcacaagtccctgtgcacgccagcttgtttgccagtgagtggcgtcatgataagacaaaattctctgctctgagacctaagcacatgaagtttttaaaaaaattttctctgagaagatcccattttttactctaaaagatcagaccagtgtggcatgtgtggaactgctctgtaccaagatcacactcttcagttggagaagaggaagggcaggaataaataaagggctttcctgtctcccgagggagcagagaaagctttcgctgtcctcttccttccccagccacagcctggggttgggggactggaaacaagctcaggctagcacttgatgttcagacggtagtctgaaagtttgactagggagttaatgatctgaccagagagacaggtttttattttgagaactgacaagctttgtgtccttaaaacaaaggaagtagttaaaccaaggccccagaaagagaaattcactgcatgtaactatgaccacgcatgattttatcagaagttgattagaatctgtaacattttctgtagttcagctgacacactgaagatgtcctcactgtgaccagccttgtcaacagctggatcacagtgacataagctgtgtctaggatgagtcttgcggtctgcagccgtgtgaggctgcatctgattcccaagtccaatggctctcttcccgtgtttacagatcaggccatgacctttccctacagcaggatgtttgcaagattaactctcaactgaggaatttgcttatttgctctaatactgcttggttgagagagttcaaagtagaaagtcttctgaggggataagattcatgtattatttacagtgcttcagttgcatgtatcagaaaatctagtctaaattgctttaacagaaaaagatgttgctggtccatttgacgaagaagtccagagcggcttgtgacttcagtctggctttgcagagcccaggtgctctctccaccttctgccaggttcccctacgaaggctttgctctcagactctccccttgtggagacaaaaatcccacagcaagtggaaacagaagtgccttggaaaaagttattctggcagctcctatacaagtcccccatcagatgctggtattggaccagctttggttataaagc

SEQ ID NO: 361280 - DNA, 1242 bp, Homo sapiens
  misc_feature (24)..(24): n is a, c, g, or t
agcaggctggtacaggcccgagangtaagatgggcagcctcgggacggggcgccgcggccgggcgggcagcatgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgaggtatcagacttggtgataattctgaattatgaccgtgctgtagaagcttttgcaaaaggcggaaatctgaccctcggagggaacttgactgtggcggttgggcccttgggaagattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgtaccgtttggttttatgtttcactcagtattctcagaaaatctctttctgtagaacattctgtccctgatatcaggttcctaagaacctactaagcctccttcgtagtttcactgacttcacattcttgtgaaaaggtcatgctaccttgacatttcctctgtacagatttcagggaaaaacataatttgtcctctgtgattgcatttctccaaggatggaactttgttgtatcaataatacaaataatatgtgggaggctgaggcaggtggagcacttgagatcaggagtttcagaccagcctggccaacatggcaaaaccccctctctaccataaaaatagaaacattagctgggcatggtggcgtgtgcccataatctcagctactcaggaggctgaaacaggaggatcgcttgagcccatgaggttgcactgagccaagatcatgccattgcactcagcctaggcaacagagtaagaccttatctcaataataatatatgaataatagttgcagatactgacgcctttgtatgtcaggccttggggcaccgagggatttgtgtgcattgttcatgatgttccacagcaccttt

SEQ ID NO: 361281 - DNA, 868 bp, Homo sapiens
agcggagtgtgcctgcggaggcggtcctatgacggaaaactttattctcaagagatttctcattccgcagaaataaggatctggcatgtcaacacaaacataggaagttgaggcagtcaaagggaaataactgctaccctgactctgctgagagcctcacaagtccctgtgcacgccagcttgtttgccatgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgaggtatcagacttggtgataattctgaattatgaccgtgctgtagaagcttttgcaaaaggcggaaatctgaccctcggagggaacttgactgtggcggttgggcccttgggaagattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagtaaatatttttgttgcaattcaaata

SEQ ID NO: 361282 - DNA, 2100 bp, Homo sapiens
ccgtgccgggttcgtctgacagatcccaggggagcccacgccccacgtggccgccaaggggtgacatgggcactcgatggggtctgggcagaaagccgtgctcccctcacctccgtgcctctggtcttctgcagacggactggactgagccctggctcatggggctggccaccttccacgcgctctgcgtgctcctcacctgcttgtcctcccgaagctacagactacagatcgggcactttctgtgtctagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactggaatttgattgaagaagtccatgtcatatgtgtaactagtactaattataaatataaaatacacaatataaaatatgaaactcaataataaacagtgccacctgtacatgggcaccatgccctcctcctcgtgctgtgttttctagtgcatgccacagttcgcagtagagggtgttttcaccttccaagacatggggcaaagtttggagacacctggttgtcactggagggggtggtgctcctggcttctcctgtggagcccggggtgatgcataaaatcctgtgtgcctgggtcagccgcatcacagacaatgacttgacatgaaatgtcagctgtgctggggcagagagaccttggaaggaagctcttggaaaatacgttgtatctcagtttgatgaaccaattcacaagaggctaggccctctctagcaaagttatgggctgctttactgaaaacagaatggaagccctgaagtcaacactccatggagaagcgtgtctttcctaatgtcctggtgttctgttgatttaggtgcttgggaacacaatgctcccagttctgttaggacaggcatactgttactttgcaatatccactttataaaatagctcctgcccagtggctcttggttcctgtcaaatgtggacctgtagtttaagaatgacaggtggttagagacccagatatttaaaaataggtgttcaataagggaatactgattgtgcattgtatctggatagcatgcctaattgtgcatttctgaaagttaccaattcaaaatgtaattggaacagttatctttgattagacaagcctgggaagagaatgttgaggtgcagagctcaccagccaagttcatgcccctctcgggcctttgtggctgagaagtgggacagaaagatgattaaggtaatgtgtcctccctgtagcattgtccagggccgttgtgtagatatttgacttcactgacagaaaagaaaccagggagtttgtagagactgtgcatttttagtataacattttcaccatctgatatggtttggctttgtgtccccacccaaattgcatctcaaattgtaatccccatgtgtcaagggagggacctgatgggaggtgatgggatcatgggggtggtttcccctatgttgttatcataatagagagggagttctcacaagatctgctggttttaaagacagcagtttcccctgctgtcactgtctctctcctgctgccttgtgaagaaggtgcttgtttctccctctgccatgattgtaagtttcccgaggcctccccggccatgtggaactgagtcaattaaacttcttgtttataaagt

SEQ ID NO: 361283 - DNA, 446 bp, Homo sapiens
agcggagtgtgcctgcggaggcggtcctatgacggaaaactttattctcaagagatttctcattccgcagaaataaggatctggcatgtcaacacaaacataggaagttgaggcagtcaaagggaaataactgctaccctgactctgctgagagcctcacaagtccctgtgcacgccagcttgtttgccaaaaaagatgttgctggtccatttgacgaagaagtccagagcggcttgtgacttcagtctggctttgcagagcccaggtgctctctccaccttctgccaggttcccctacgaaggctttgctctcagactctccccttgtggagacaaaaatcccacagcaagtggaaacagaagtgccttggaaaaagttattctggcagctcctatacaagtcccccatcagatgctggtattggaccagctttggttataaagc

SEQ ID NO: 361284 - DNA, 1978 bp, Homo sapiens
ctggaaacaacccaattgtctatcaacagtgactggaaggacaaattgtgctatgtccacacattagaataccagttggcagtcaaaaaggaagagctgatctgtgcagcaatttgagtctcagtaatttcatgtgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgagacacatttacagctacatattccctctgagcattgccctggctgccttccataagtgtggagtgccactccagctttcttaggttgccatctgcatgacacatctttctccatccttttactgtcaatctaatggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagtaacagaaatgaatataagctctatcctggactttccagctatcatgagagagttggcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgtttactaagttaatatttcaaaaaaaaa

SEQ ID NO: 361285 - DNA, 728 bp, Homo sapiens
agcggagtgtgcctgcggaggcggtcctatgacggaaaactttattctcaagagatttctcattccgcagaaataaggatctggcatgtcaacacaaacataggaagttgaggcagtcaaagggaaataactgctaccctgactctgctgagagcctcacaagtccctgtgcacgccagcttgtttgccatgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgagacacatttacagctacatattccctctgagcattgccctggctgccttccataagtgtgggttaccatctggtgtcatttccttactccaagacaactttgctcccacctgactcttttgtacggttattgtctagtatataatatttctatagttacagacttaaaatatagaaaaaatttatttttaaaccaattaagagaaaagagaagaactatgcatttatactattatttatggttagataa

SEQ ID NO: 361286 - DNA, 1782 bp, Homo sapiens
  misc_feature (24)..(24): n is a, c, g, or t
agcaggctggtacaggcccgagangtaagatgggcagcctcgggacggggcgccgcggccgggcgggcagcatgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgaggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagtaacagaaatgaatataagctctatcctggactttccagctatcatgagagagttggcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgtttactaagttaatatttcaaaaaaaaa

SEQ ID NO: 361287 - DNA, 1733 bp, Homo sapiens
tggaggggaaggagccgcgggagtgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgaggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagtaacagaaatgaatataagctctatcctggactttccagctatcatgagagagttggcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgtttactaagttaatatttcaaaaaaaaa

SEQ ID NO: 361288 - DNA, 1371 bp, Homo sapiens
  misc_feature (24)..(24): n is a, c, g, or t
agcaggctggtacaggcccgagangtaagatgggcagcctcgggacggggcgccgcggccgggcgggcagcatgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgaggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgtaccgtttggttttatgtttcactcagtattctcagaaaatctctttctgtagaacattctgtccctgatatcaggttcctaagaacctactaagcctccttcgtagtttcactgacttcacattcttgtgaaaaggtcatgctaccttgacatttcctctgtacagatttcagggaaaaacataatttgtcctctgtgattgcatttctccaaggatggaactttgttgtatcaataatacaaataatatgtgggaggctgaggcaggtggagcacttgagatcaggagtttcagaccagcctggccaacatggcaaaaccccctctctaccataaaaatagaaacattagctgggcatggtggcgtgtgcccataatctcagctactcaggaggctgaaacaggaggatcgcttgagcccatgaggttgcactgagccaagatcatgccattgcactcagcctaggcaacagagtaagaccttatctcaataataatatatgaataatagttgcagatactgacgcctttgtatgtcaggccttggggcaccgagggatttgtgtgcattgttcatgatgttccacagcaccttt

SEQ ID NO: 361289 - DNA, 2581 bp, Homo sapiens
ccgtgccgggttcgtctgacagatcccaggggagcccacgccccacgtggccgccaaggggtgacatgggcactcgatggggtctgggcagaaagccgtgctcccctcacctccgtgcctctggtcttctggtacagcagggtcccggggagtccaggaggcggcggagtgcggcactgtctggagagttcactgtattgcagagaggttggagaaaatcaagtcttgcacgtggcgatggctcaagattccctgaggtcttcagtgctgactaaggagtctgaaatgatgattcatgttttacctttggggctgagccaagtgcatctctttgagcaatcgtcttaatttccttgtcgtcaccaattatcataaccaattatcatcgtaaaggatggtaattcctttaattatacccaccttaaaaacatgattctgttccacaaacgaaaggagcacatcagagatgccttcagttctgtgtgcttgaactttgaattccatgaattatagttgcactgaggggagaatcctgtttacatcctcctggttccttctccctttcctgtccccatgtttctctgaggcctggcaatgctctctggatacttgcagacggactggactgagccctggctcatggggctggccaccttccacgcgctctgcgtgctcctcacctgcttgtcctcccgaagctacagactacagatcgggcactttctgtgtctagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactggaatttgattgaagaagtccatgtcatatgtgtaactagtactaattataaatataaaatacacaatataaaatatgaaactcaataataaacagtgccacctgtacatgggcaccatgccctcctcctcgtgctgtgttttctagtgcatgccacagttcgcagtagagggtgttttcaccttccaagacatggggcaaagtttggagacacctggttgtcactggagggggtggtgctcctggcttctcctgtggagcccggggtgatgcataaaatcctgtgtgcctgggtcagccgcatcacagacaatgacttgacatgaaatgtcagctgtgctggggcagagagaccttggaaggaagctcttggaaaatacgttgtatctcagtttgatgaaccaattcacaagaggctaggccctctctagcaaagttatgggctgctttactgaaaacagaatggaagccctgaagtcaacactccatggagaagcgtgtctttcctaatgtcctggtgttctgttgatttaggtgcttgggaacacaatgctcccagttctgttaggacaggcatactgttactttgcaatatccactttataaaatagctcctgcccagtggctcttggttcctgtcaaatgtggacctgtagtttaagaatgacaggtggttagagacccagatatttaaaaataggtgttcaataagggaatactgattgtgcattgtatctggatagcatgcctaattgtgcatttctgaaagttaccaattcaaaatgtaattggaacagttatctttgattagacaagcctgggaagagaatgttgaggtgcagagctcaccagccaagttcatgcccctctcgggcctttgtggctgagaagtgggacagaaagatgattaaggtaatgtgtcctccctgtagcattgtccagggccgttgtgtagatatttgacttcactgacagaaaagaaaccagggagtttgtagagactgtgcatttttagtataacattttcaccatctgatatggtttggctttgtgtccccacccaaattgcatctcaaattgtaatccccatgtgtcaagggagggacctgatgggaggtgatgggatcatgggggtggtttcccctatgttgttatcataatagagagggagttctcacaagatctgctggttttaaagacagcagtttcccctgctgtcactgtctctctcctgctgccttgtgaagaaggtgcttgtttctccctctgccatgattgtaagtttcccgaggcctccccggccatgtggaactgagtcaattaaacttcttgtttataaagt

SEQ ID NO: 361290 - DNA, 1603 bp, Homo sapiens
  misc_feature (1536)..(1537): n is a, c, g, or t
ggcagatctcacgagagaggatttggcgccctcctctgtggattctggccaggccgggttcggcggttgctgtgagagcgggcttcccaacaccatgccgtccgccttctctgtcagctctttccccgtcagcatcccagccgtgctcacggtacagcagggtcccggggagtccaggaggcggcggagtgcggcactgtctggagagttcactgtattgcagagaggttggagaaaatcaagtcttgcacgtggcgatggctcaagattccctgaggtcttcagtgctgactaaggagtctgaaatgatgattcatgttttacctttggggctgagccaagtgcatctctttgagcaatcgtcttaatttccttgtcgtcaccaattatcataaccaattatcatcgtaaaggatggtaattcctttaattatacccaccttaaaaacatgattctgttccacaaacgaaaggagcacatcagagatgccttcagttctgtgtgcttgaactttgaattccatgaattatagttgcactgaggggagaatcctgtttacatcctcctggttccttctccctttcctgtccccatgtttctctgaggcctggcaatgctctctggatacttggtgagtagcccaggaggactcaggagtgagaggcccctgcctcctgcgctgggagaaggctgtgggtgggccgtgaaccccggccttgagtggcaggacagtgagtgtctgctggtgtgttcctacagcagacggactggactgagccctggctcatggggctggccaccttccacgcgctctgcgtgctcctcacctgcttgtcctcccgaagctacagactacagatcgggcactttctgtgtctagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggttatgtgggtatggaagactttgaatgtgatgactgacctgaagaatgcacaagagagaagaaaggaaaagaaaaggagaaggaaagaagactcgggggccccccgtggttggatttccgggcctttcccgaccacccaagcagctcccaaggcgtggaggtggggggggtgcgcccaccctccagcctgactagggggttaaaacaacctctttttattctaatatgccgcaggggcggggggccaccctttattttgcgtttctcccccaacctggtagttgttcttccgagaaatcgcccggtcgagggcgcatggttcttatggggcggcggtgtgggacacaccccctggcggagcgtcgtcacacggaacatggtgtatagaagaagcccatgccatactttgtggctgaccgtcggtggaaagtgaataaccggcgggcgtgaatcttgaaagtctggtataaatcgggtcggcctcgggcaggagaacgacgacaannaaaaagagcagcaagcgtccagaggacgcaacgagggagggcgggaggggtgacgggggtgggtgg

SEQ ID NO: 361291 - DNA, 2386 bp, Homo sapiens
ggcagatctcacgagagaggatttggcgccctcctctgtggattctggccaggccgggttcggcggttgctgtgagagcgggcttcccaacaccatgccgtccgccttctctgtcagctctttccccgtcagcatcccagccgtgctcacggtacagcagggtcccggggagtccaggaggcggcggagtgcggcactgtctggagagttcactgtattgcagagaggttggagaaaatcaagtcttgcacgtggcgatggctcaagattccctgaggtcttcagtgctgactaaggagtctgaaatgatgattcatgttttacctttggggctgagccaagtgcatctctttgagcaatcgtcttaatttccttgtcgtcaccaattatcataaccaattatcatcgtaaaggatgcagacggactggactgagccctggctcatggggctggccaccttccacgcgctctgcgtgctcctcacctgcttgtcctcccgaagctacagactacagatcgggcactttctgtgtctagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactggaatttgattgaagaagtccatgtcatatgtgtaactagtactaattataaatataaaatacacaatataaaatatgaaactcaataataaacagtgccacctgtacatgggcaccatgccctcctcctcgtgctgtgttttctagtgcatgccacagttcgcagtagagggtgttttcaccttccaagacatggggcaaagtttggagacacctggttgtcactggagggggtggtgctcctggcttctcctgtggagcccggggtgatgcataaaatcctgtgtgcctgggtcagccgcatcacagacaatgacttgacatgaaatgtcagctgtgctggggcagagagaccttggaaggaagctcttggaaaatacgttgtatctcagtttgatgaaccaattcacaagaggctaggccctctctagcaaagttatgggctgctttactgaaaacagaatggaagccctgaagtcaacactccatggagaagcgtgtctttcctaatgtcctggtgttctgttgatttaggtgcttgggaacacaatgctcccagttctgttaggacaggcatactgttactttgcaatatccactttataaaatagctcctgcccagtggctcttggttcctgtcaaatgtggacctgtagtttaagaatgacaggtggttagagacccagatatttaaaaataggtgttcaataagggaatactgattgtgcattgtatctggatagcatgcctaattgtgcatttctgaaagttaccaattcaaaatgtaattggaacagttatctttgattagacaagcctgggaagagaatgttgaggtgcagagctcaccagccaagttcatgcccctctcgggcctttgtggctgagaagtgggacagaaagatgattaaggtaatgtgtcctccctgtagcattgtccagggccgttgtgtagatatttgacttcactgacagaaaagaaaccagggagtttgtagagactgtgcatttttagtataacattttcaccatctgatatggtttggctttgtgtccccacccaaattgcatctcaaattgtaatccccatgtgtcaagggagggacctgatgggaggtgatgggatcatgggggtggtttcccctatgttgttatcataatagagagggagttctcacaagatctgctggttttaaagacagcagtttcccctgctgtcactgtctctctcctgctgccttgtgaagaaggtgcttgtttctccctctgccatgattgtaagtttcccgaggcctccccggccatgtggaactgagtcaattaaacttcttgtttataaagt

SEQ ID NO: 361292 - DNA, 368 bp, Homo sapiens
tacccagcccctatctaagatggagttgctctggttcaaatgcccctgacacatccagtggcaagggaggctaggaaatgaaagagttttgtttatctgaatttaccacataaaattgtaaagatgaaaggaggttatgtatatgagggcttggcaaatgtttgttctttgggctgtggtcttacacaagttactaaatgtctaggaaatttcagtttccaatttgtaaaatggaactaataagagtactttcctctattggcatttgttacttttggaccttgagcagctgaattcccctgcctaagctggggaattccccaccgtattactctaggtaggaagcagagtcacttcgcagtaatggc

SEQ ID NO: 361293 - DNA, 1158 bp, Homo sapiens
ggtcacacagagagtacgtgtcaaaggaaactcaaaagaacacattttctcagtgattacaggttttagagaagaggaacaatgcttcctctgagcctgaagaaaagaatgaaataagggctgcaagggaacatgcaggtttcacactacaggagcttgtctgtcttggtgcaagtgggagcattccagttggcttttgagtggatacgtgcagtgagatcattgacactggaaacactagttcccattttaattacttaaaacaccacgatgaaaagaaatacctgtgatttgctttctcggagcaaaagtgcctctgaggaaacactacattccagtaatgaagaggaagaccctttccgcggaatggaaccctatcttgtccggagactttcatgtcgcaatattcagcttccccctctcgccttcagacagttggaacaagctgacttgaaaagtgaatcagagaacattcaacgaccaaccagcctccccctgaagattctgccgctgattgctatcacttctgcagaatccagtgggtgagtgccctcagatgtcatttccccattttatattttagatggtgattgttgtctgtggtcttttgagtttttgtggctcattgcttgatttgagtgggagaacaatggggtttctagagtcaaaaaaaaaaggatgaatttctcaggtgacatttctatatctgcaggagaagacattttagtgaaattgttttacatggaagagctgaaaatgtattggtgaatgctaataaacatttgccaaagggcagttgtacttggaaaattaatattggccatatgtgacttgatagaagacattttaacaaatgagaactaatggacaaattaccatgtagtgatacatgtctagaaacaataggaaatgttcactgatgcaaaatgaatttggaatcaagaataaattgtattgtaattagaatcaaaagaaatatgcaatggtattcatgagtctaaaaattttgcctttgacattttgaggtattgcttaccagaatactatttcagctcccagtataaggtgattttatttagcattagtacttatagaggagtcagccacagccacgtctccatcatgtaacatttttatttcctactttgcagggtataa

SEQ ID NO: 361294 - DNA, 988 bp, Homo sapiens
ggtcacacagagagtacgtgtcaaaggaaactcaaaagaacacattttctcagtgattacaggttttagagaagaggaacaatgcttcctctgagcctgaagaaaagaatgaaataagggctgcaagggaacatgcaggtttcacactacaggagcttgtctgtcttggtgcaagtgggagcattccagttggcttttgagtggatacgtgcagtgagatcattgacactggaaacactagttcccattttaattacttaaaacaccacgatgaaaagaaatacctgtgatttgctttctcggagcaaaagtgcctctgaggaaacactacattccagtaatgaagaggaagaccctttccgcggaatggaaccctatcttgtccggagactttcatgtcgcaatattcagcttccccctctcgccttcagacagttggaacaagctgacttgaaaagtgaatcagagaacattcaacgaccaaccagcctccccctgaagattctgccgctgattgctatcacttctgcagaatccagtgggagaagacattttagtgaaattgttttacatggaagagctgaaaatgtattggtgaatgctaataaacatttgccaaagggcagttgtacttggaaaattaatattggccatatgtgacttgatagaagacattttaacaaatgagaactaatggacaaattaccatgtagtgatacatgtctagaaacaataggaaatgttcactgatgcaaaatgaatttggaatcaagaataaattgtattgtaattagaatcaaaagaaatatgcaatggtattcatgagtctaaaaattttgcctttgacattttgaggtattgcttaccagaatactatttcagctcccagtataaggtgattttatttagcattagtacttatagaggagtcagccacagccacgtctccatcatgtaacatttttatttcctactttgcagggtataa

SEQ ID NO: 361295 - DNA, 377 bp, Homo sapiens
tggactgtgggaagcgtgggcaggtgtgtgggtactggtgaacctcagagactcagagaagggctgcagagggcggagtggggggcacagcagagcaggtcggggaacagtgcccagctgggggcttgggaacaggacgctgggagacagcagcatttggggtggctgtgggaaggggctgcttctggccagggatgagtttgaccaggtggctggaggctgagcccgggcataccattctcaaagtgagtggtgagtttgggggcccctcagacagcgagctggaaatggagagggtggagggtgcagcttgatgatgggctggccaggtgcccacgtggtcaggcgaggtgctaggggagcaggaggaccctcgc

SEQ ID NO: 361296 - DNA, 2586 bp, Homo sapiens
gcggtcagggatcatgagggagagtgcgttggagccggggcctgtgcccgaggcgccggcggggggtcccgtgcacgccgtgacggtggtgaccctgctggagaagctggcctccatgctggagactctgcgggagcggcagggaggcctggctcgaaggcagggaggcctggcagggtccgtgcgccgcatccagagcggcctgggcgctctgagtcgcagccacgacaccaccagcaacaccttggcgcagctgctggccaaggcggagcgcgtgagctcgcacgccaacgccgcccaagagcgcgcggtgcgccgcgcagcccaggtgcagcggctggaggccaaccacgggctgctggtggcgcgcgggaagctccacgttctgctcttcaaggaggagggtgaagtcccagccagcgctttccagaaggcaccagagcccttgggcccggcggaccagtccgagctgggcccagagcagctggaggccgaagttggagagagctcggacgaggagccggtggagtccagggcccagcggctgcggcgcaccggattgcagaaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaattt

SEQ ID NO: 361297 - DNA, 341 bp, Homo sapiens
  misc_feature (7)..(7): n is a, c, g, or t
  misc_feature (26)..(26): n is a, c, g, or t
  misc_feature (82)..(82): n is a, c, g, or t
  misc_feature (112)..(112): n is a, c, g, or t
ccgcccngggagttaggtctgcaggnagtccccaggggagccacgagcttgtttcctgcacggagctgtcgcctcatggagngtctcagccccggtgctcctttgcccgcgncgcacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacagtatcctttggttgttgagttcatttgactgctcggttctaaatttagggaaacagaagggaggctttc

SEQ ID NO: 361298 - DNA, 273 bp, Homo sapiens
gtaaaaggagccagtcctgggacaagaagaatcagacaacgctggtgtgaaataggagagaagcacagaggtttaagaattgtttaagctgcatcaatggagcacatacagggagcttggaagacgatcagcaatggttttggattcaaagatgccgtgtttgatggctccagctgcatctctcctacaatagttcagcagtttggctcgcagctgcgccgcactgcgagcgtttatttgcacgatacaacatgagacggtaccgagctgata

SEQ ID NO: 361299 - DNA, 5109 bp, Homo sapiens
ggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgcaggttgaacaacctactggctctgtcctctggatggtgagaatctgggctcccaccagcagtctctggtatagggcaaaaggaatgccttggagatttatgtgcaaacttaaagcgtttctgtacatttccccgaaatccacatgacccctagtgacagccagcctcagggcaattgtagattttcttgaggaagctgttgatcagaaccactgtgaagcttagtgtggagaggagttaataagctgggtgacagaaatgctgggtcttggtcctttaaagacaaggattcctgagctgttttaaccagtgcctgagttggagtcctttgggggaaaagctatgtggggactgaagaatggactcattcataactaatgaaagggacagcctggcccctagatgtctgtgaggcctgtcatatggtgataaatgcacttttgtcatatggtgatacatgtaggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaatggctggctgttacctccttttaaagtaattctgagctcacaacttgaatgccccatttgttcaccctcttcaggagcagaattcaagaacaggaaatgtgcccagagcctaggctgggaatgaatttgtaatttaacctttgtactctttgtaaacctctactgaagagttaagtataaaaattaattaagcagaaagtactctaaactcagctaataccttaagtaatacattttataaactatttatttatttggtaggtacagcttttttaaacacaaaaatagattagataaattccagcttggaacaagctagtgctggttcacaaggttatgctcacccttcaattaaaatcaaaatgactacaagacttgccatcagctctcttcaggaccactgctgggtcagaatcagaaaccttgggtgccatgaaatttttacaaaatttcaaatcaaagccaggctttgcagctagataatagatcacttgagtacgaaccacacatgtaagtgcacgtatatttgagttctcaatacaattaccctgatgggcaagaacccacaggtgagagcagaggcttggttcccctagagggccctggctggaggccccaacaccaaccagacgacaggagggccagactgctacccagtactgtacctcctgctccttcaagagcctccctaagggagaagaagatctatacttccactttgtttgctgcacatgtggcaacaagattgctaccctgatttgggacacttgagagaacttgaaaaaaatgaccacccttaaagccctagaaaaaagttgtatgtttgttaacagctatgctgcgctcactttgcattgtgtgttcttgaaagctctgtataaatcaaaattttgacgacacactaaatacactagagaaatacactatagaggaatccttttatagggctgaagactcctttggtaagaaaaatatgctgcattaggggcagctgcaagtttactatttctggggaagaaaagatcaaagataagagccaggtttgttttttaaagcaatcaatccaaacagtttgggtgtttgttagttgttacccctgaggggcttgaggtgtaactatatcagctataaaaatagcaattccatacatttaattaggttactttatatctttcactcttccccatggctgtaataatggagattgaatgagactaaggctaagcccaactccactcaaatccaagtcacacgtcaccttggctgcagtacagggaagctccgcacaccctggcttgggaaagtttcggccgatggagcccaagatgcagggcaaccatctactctttagggttctgatgattccactccagaaaggtgcatgaagaggtccccgagctctgtcatgtcgacatcttcattgttggggacatgccggctttctcggttctcgatgaaatcccagagccgcactgaattaaagaact

SEQ ID NO: 361300 - DNA, 4637 bp, Homo sapiens
ggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaatggctggctgttacctccttttaaagtaattctgagctcacaacttgaatgccccatttgttcaccctcttcaggagcagaattcaagaacaggaaatgtgcccagagcctaggctgggaatgaatttgtaatttaacctttgtactctttgtaaacctctactgaagagttaagtataaaaattaattaagcagaaagtactctaaactcagctaataccttaagtaatacattttataaactatttatttatttggtaggtacagcttttttaaacacaaaaatagattagataaattccagcttggaacaagctagtgctggttcacaaggttatgctcacccttcaattaaaatcaaaatgactacaagacttgccatcagctctcttcaggaccactgctgggtcagaatcagaaaccttgggtgccatgaaatttttacaaaatttcaaatcaaagccaggctttgcagctagataatagatcacttgagtacgaaccacacatgtaagtgcacgtatatttgagttctcaatacaattaccctgatgggcaagaacccacaggtgagagcagaggcttggttcccctagagggccctggctggaggccccaacaccaaccagacgacaggagggccagactgctacccagtactgtacctcctgctccttcaagagcctccctaagggagaagaagatctatacttccactttgtttgctgcacatgtggcaacaagattgctaccctgatttgggacacttgagagaacttgaaaaaaatgaccacccttaaagccctagaaaaaagttgtatgtttgttaacagctatgctgcgctcactttgcattgtgtgttcttgaaagctctgtataaatcaaaattttgacgacacactaaatacactagagaaatacactatagaggaatccttttatagggctgaagactcctttggtaagaaaaatatgctgcattaggggcagctgcaagtttactatttctggggaagaaaagatcaaagataagagccaggtttgttttttaaagcaatcaatccaaacagtttgggtgtttgttagttgttacccctgaggggcttgaggtgtaactatatcagctataaaaatagcaattccatacatttaattaggttactttatatctttcactcttccccatggctgtaataatggagattgaatgagactaaggctaagcccaactccactcaaatccaagtcacacgtcaccttggctgcagtacagggaagctccgcacaccctggcttgggaaagtttcggccgatggagcccaagatgcagggcaaccatctactctttagggttctgatgattccactccagaaaggtgcatgaagaggtccccgagctctgtcatgtcgacatcttcattgttggggacatgccggctttctcggttctcgatgaaatcccagagccgcactgaattaaagaact

SEQ ID NO: 361301 - DNA, 3241 bp, Homo sapiens
ggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaattt

SEQ ID NO: 361302 - DNA, 4627 bp, Homo sapiens
ggggatatctttttaaggaaagaggcagaggacaggaaaacagaaaagtcagaaaattagtaggcttggcctgtccctcagcagcttatgcctcacctggactgatgagagcgatgtttaggttaggttcctttctgagtttatctcagcaaaagtgatttggagagatttccgtaagcttgaaataggcataattttatcacactattagtaaatgtaacctgacggggattgggcttttgtcttaagtttatttctagtttgtggccagcgtgtgtatgtctatctgcttgttatgtggatagcaagtagctacaagccaaatgttgaaaggtttccaaaatcactaattaaaatagtctttcttgactgggcgtgatggctcacacctataatcccagcactttgggaggctgaggcaggtggatcacttgaggctaggagtttgagacttgcctggccaatgtggtgaaaccccatctctaaatttaaaaattagctgagtgtggtggcacgtacctataatcccagctactcaggaggctgaggcacgagaattgcttgaacctgggaggcagaggttgcagtgagctgagatcacgccactgcactccagccttggggacagagcaaggctgtgtctcaaaaaaataaataaataaaatggtctttctcaaaggtacataagtgggttcttcagaagtcactattagaagaggagaggggttgtttttatagaagagtaaatgaagaaaggtatttttaatgctgtgaggcgtgaaatttaacaattttgaatctgccaccctccacgagcctttccttgtgaaagaaagatggcattacaacccacgttttgcctcttgagcagtgagaggcatgatagttgtgttggattatgggacatggcctattttaggtacatgtctgaggtgtggaacacctttcagtggtggggtttttagcagccaaacattataccatgaaagcagacaccacagatttaaggaggtgtgaattcctgggcaccaacatcacaagttactttgtgtgtgtttgttttttaattttttgttcttttttaatttttttttcctcacaagtttgacttaaactgtatgacttctttacccagaagcgagccgacttcagttctcattttgaagtcactgagtggtaccgattctagtgaggaatttcttactacaacattgaacactcagtaagggatttgctattttgttaaccactcaagtttcagatggtgatttgagggcagaatacaggcagaaacgactgtaagctgtcaggccatccttggccctctggggagcactggagtgtggcctctgctcatcctgttagggtttcaagtacctgtattatgtggaaaggtcacaaggccagagacccagcacctagatgtgcaaatggggagaagaagcagggaagaaacgctggcttgcttttggctagggccaaataatctggcacattgaccaatccctgcctgtcttctggaagaaggtgcatttcaaaagcactttaaagaacttcagaaaccttaggaagttcagtgcagagaggctgtgacagaggtaaggtggagagattaccgtgttataaagaactttgggatatttttcaaaattaacctgaccattcttttgaaaccagagtccttaacaagcattgagatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaatggctggctgttacctccttttaaagtaattctgagctcacaacttgaatgccccatttgttcaccctcttcaggagcagaattcaagaacaggaaatgtgcccagagcctaggctgggaatgaatttgtaatttaacctttgtactctttgtaaacctctactgaagagttaagtataaaaattaattaagcagaaagtactctaaactcagctaataccttaagtaatacattttataaactatttatttatttggtaggtacagcttttttaaacacaaaaatagattagataaattccagcttggaacaagctagtgctggttcacaaggttatgctcacccttcaattaaaatcaaaatgactacaagacttgccatcagctctcttcaggaccactgctgggtcagaatcagaaaccttgggtgccatgaaatttttacaaaatttcaaatcaaagccaggctttgcagctagataatagatcacttgagtacgaaccacacatgtaagtgcacgtatatttgagttctcaatacaattaccctgatgggcaagaacccacaggtgagagcagaggcttggttcccctagagggccctggctggaggccccaacaccaaccagacgacaggagggccagactgctacccagtactgtacctcctgctccttcaagagcctccctaagggagaagaagatctatacttccactttgtttgctgcacatgtggcaacaagattgctaccctgatttgggacacttgagagaacttgaaaaaaatgaccacccttaaagccctagaaaaaagttgtatgtttgttaacagctatgctgcgctcactttgcattgtgtgttcttgaaagctctgtataaatcaaaattttgacgacacactaaatacactagagaaatacactatagaggaatccttttatagggctgaagactcctttggtaagaaaaatatgctgcattaggggcagctgcaagtttactatttctggggaagaaaagatcaaagataagagccaggtttgttttttaaagcaatcaatccaaacagtttgggtgtttgttagttgttacccctgaggggcttgaggtgtaactatatcagctataaaaatagcaattccatacatttaattaggttactttatatctttcactcttccccatggctgtaataatggagattgaatgagactaaggctaagcccaactccactcaaatccaagtcacacgtcaccttggctgcagtacagggaagctccgcacaccctggcttgggaaagtttcggccgatggagcccaagatgcagggcaaccatctactctttagggttctgatgattccactccagaaaggtgcatgaagaggtccccgagctctgtcatgtcgacatcttcattgttggggacatgccggctttctcggttctcgatgaaatcccagagccgcactgaattaaagaact

SEQ ID NO: 361303 - DNA, 5054 bp, Homo sapiens
ggggatatctttttaaggaaagaggcagaggacaggaaaacagaaaagtcagaaaattagtaggcttggcctgtccctcagcagcttatgcctcacctggactgatgagagcgatgtttaggttaggttcctttctgagtttatctcagcaaaagtgatttggagagatttccgtaagcttgaaataggcataattttatcacactattagtaaatgtaacctgacggggattgggcttttgtcttaagtttatttctagtttgtggccagcgtgtgtatgtctatctgcttgttatgtggatagcaagtagctacaagccaaatgttgaaaggtttccaaaatcactaattaaaatagtctttcttgactgggcgtgatggctcacacctataatcccagcactttgggaggctgaggcaggtggatcacttgaggctaggagtttgagacttgcctggccaatgtggtgaaaccccatctctaaatttaaaaattagctgagtgtggtggcacgtacctataatcccagctactcaggaggctgaggcacgagaattgcttgaacctgggaggcagaggttgcagtgagctgagatcacgccactgcactccagccttggggacagagcaaggctgtgtctcaaaaaaataaataaataaaatggtctttctcaaaggtacataagtgggttcttcagaagtcactattagaagaggagaggggttgtttttatagaagagtaaatgaagaaaggtatttttaatgctgtgaggcgtgaaatttaacaattttgaatctgccaccctccacgagcctttccttgtgaaagaaagatggcattacaacccacgttttgcctcttgagcagtgagaggcatgatagttgtgttggattatgggacatggcctattttaggtacatgtctgaggtgtggaacacctttcagtggtggggtttttagcagccaaacattataccatgaaagcagacaccacagatttaaggaggtgtgaattcctgggcaccaacatcacaagttactttgtgtgtgtttgttttttaattttttgttcttttttaatttttttttcctcacaagtttgacttaaactgtatgacttctttacccagaagcgagccgacttcagttctcattttgaagtcactgagtggtaccgattctagtgaggaatttcttactacaacattgaacactcagtaagggatttgctattttgttaaccactcaagtttcagatggtgatttgagggcagaatacaggcagaaacgactgtaagctgtcaggccatccttggccctctggggagcactggagtgtggcctctgctcatcctgttagggtttcaagtacctgtattatgtggaaaggtcacaaggccagagacccagcacctagatgtgcaaatggggagaagaagcagggaagaaacgctggcttgcttttggctagggccaaataatctggcacattgaccaatccctgcctgtcttctggaagaaggtgcatttcaaaagcactttaaagaacttcagaaaccttaggaagttcagtgcagagaggctgtgacagaggtaaggtggagagattaccgtgttataaagaactttgggatatttttcaaaattaacctgaccattcttttgaaaccagagtccttaacaagcattgagatatatttctccatgaaggcttaacagtgaaaattggagattttggtttggcaacagtaaagtcacgctggagtggttctcagcaggttgaacaacctactggctctgtcctctggatggtgagaatctgggctcccaccagcagtctctggtatagggcaaaaggaatgccttggagatttatgtgcaaacttaaagcgtttctgtacatttccccgaaatccacatgacccctagtgacagccagcctcagggcaattgtagattttcttgaggaagctgttgatcagaaccactgtgaagcttagtgtggagaggagttaataagctgggtgacagaaatgctgggtcttggtcctttaaagacaaggattcctgagctgttttaaccagtgcctgagttggagtcctttgggggaaaagctatgtggggactgaagaatggactcattcataactaatgaaagggacagcctggcccctagatgtctgtgaggcctgtcatatggtgataaatgcacttttgtcatatggtgatacatgtaggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaatggctggctgttacctccttttaaagtaattctgagctcacaacttgaatgccccatttgttcaccctcttcaggagcagaattcaagaacaggaaatgtgcccagagcctaggctgggaatgaatttgtaatttaacctttgtactctttgtaaacctctactgaagagttaagtataaaaattaattaagcagaaagtactctaaactcagctaataccttaagtaatacattttataaactatttatttatttggtaggtacagcttttttaaacacaaaaatagattagataaattccagcttggaacaagctagtgctggttcacaaggttatgctcacccttcaattaaaatcaaaatgactacaagacttgccatcagctctcttcaggaccactgctgggtcagaatcagaaaccttgggtgccatgaaatttttacaaaatttcaaatcaaagccaggctttgcagctagataatagatcacttgagtacgaaccacacatgtaagtgcacgtatatttgagttctcaatacaattaccctgatgggcaagaacccacaggtgagagcagaggcttggttcccctagagggccctggctggaggccccaacaccaaccagacgacaggagggccagactgctacccagtactgtacctcctgctccttcaagagcctccctaagggagaagaagatctatacttccactttgtttgctgcacatgtggcaacaagattgctaccctgatttgggacacttgagagaacttgaaaaaaatgaccacccttaaagccctagaaaaaagttgtatgtttgttaacagctatgctgcgctcactttgcattgtgtgttcttgaaagctctgtataaatcaaaattttgacgacacactaaatacactagagaaatacactatagaggaatccttttatagggctgaagactcctttggtaagaaaaatatgctgcattaggggcagctgcaagtttactatttctggggaagaaaagatcaaagataagagccaggtttgttttttaaagcaatcaatccaaacagtttgggtgtttgttagttgttacccctgaggggcttgaggtgtaactatatcagctataaaaatagcaattccatacatttaattaggttactttatatctttcactcttccccatggctgtaataatggagattgaatgagactaaggctaagcccaactccactcaaatccaagtcacacgtcaccttggctgcagtacagggaagctccgcacaccctggcttgggaaagtttcggccgatggagcccaagatgcagggcaaccatctactctttagggttctgatgattccactccagaaaggtgcatgaagaggtccccgagctctgtcatgtcgacatcttcattgttggggacatgccggctttctcggttctcgatgaaatcccagagccgcactgaattaaagaact

SEQ ID NO: 361304 - DNA, 3202 bp, Homo sapiens
gatggagaggatacctgatgtaagaattgagggtgtcagagacatacaggtctagagagttagaagaagtcggtgtatatcattcgggagtacctatttgccatgaggggatgaaatactgaagctgttgatcagaaccactgtgaagcttagtgtggagaggagttaataagctgggtgacagaaatgctgggtcttggtcctttaaagacaaggattcctgagctgttttaaccagtgcctgagttggagtcctttgggggaaaagctatgtggggactgaagaatggactcattcataactaatgaaagggacagcctggcccctagatgtctgtgaggcctgtcatatggtgataaatgcacttttgtcatatggtgatacatgtaggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaatggctggctgttacctccttttaaagtaattctgagctcacaacttgaatgccccatttgttcaccctcttcaggagcagaattcaagaacaggaaatgtgcccagagcctaggctgggaatgaatttgtaatttaacctttgtactctttgtaaacctctactgaagagttaagtataaaaattaattaagcagaaagtactctaaactcagctaataccttaagtaatacattttataaactatttatttatttggtaggtacagcttttttaaacacaaaaatagattagataaattccagcttggaacaagctagtgctggttcacaaggttatgctcacccttcaattaaaatcaaaatgactacaagacttgccatcagctctcttcaggaccactgctgggtcagaatcagaaaccttgggtgccatgaaatttttacaaaatttcaaatcaaagccaggctttgcagctagataatagatcacttgagtacgaaccacacatgtaagtgcacgtatatttgagttctcaatacaattaccctgatgggcaagaacccacaggtgagagcagaggcttggttcccctagagggccctggctggaggccccaacaccaaccagacgacaggagggccagactgctacccagtactgtacctcctgctccttcaagagcctccctaagggagaagaagatctatacttccactttgtttgctgcacatgtggcaacaagattgctaccctgatttgggacacttgagagaacttgaaaaaaatgaccacccttaaagccctagaaaaaagttgtatgtttgttaacagctatgctgcgctcactttgcattgtgtgttcttgaaagctctgtataaatcaaaattttgacgacacactaaatacactagagaaatacactatagaggaatccttttatagggctgaagactcctttggtaagaaaaatatgctgcattaggggcagctgcaagtttactatttctggggaagaaaagatcaaagataagagccaggtttgttttttaaagcaatcaatccaaacagtttgggtgtttgttagttgttacccctgaggggcttgaggtgtaactatatcagctataaaaatagcaattccatacatttaattaggttactttatatctttcactcttccccatggctgtaataatggagattgaatgagactaaggctaagcccaactccactcaaatccaagtcacacgtcaccttggctgcagtacagggaagctccgcacaccctggcttgggaaagtttcggccgatggagcccaagatgcagggcaaccatctactctttagggttctgatgattccactccagaaaggtgcatgaagaggtccccgagctctgtcatgtcgacatcttcattgttggggacatgccggctttctcggttctcgatgaaatcccagagccgcactgaattaaagaact

SEQ ID NO: 361305 - DNA, 2716 bp, Homo sapiens
tagaatgtgattaaagcatgggttggttcgtaaagatggcaatataaggtgggagtgttttgttttgttttatagggaggggacccaggtcctctacaagatggtggggggcagggtacatcctgtgtctttgagacacagctaatgagagcattcttgggctttgtttcagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaatggctggctgttacctccttttaaagtaattctgagctcacaacttgaatgccccatttgttcaccctcttcaggagcagaattcaagaacaggaaatgtgcccagagcctaggctgggaatgaatttgtaatttaacctttgtactctttgtaaacctctactgaagagttaagtataaaaattaattaagcagaaagtactctaaactcagctaataccttaagtaatacattttataaactatttatttatttggtaggtacagcttttttaaacacaaaaatagattagataaattccagcttggaacaagctagtgctggttcacaaggttatgctcacccttcaattaaaatcaaaatgactacaagacttgccatcagctctcttcaggaccactgctgggtcagaatcagaaaccttgggtgccatgaaatttttacaaaatttcaaatcaaagccaggctttgcagctagataatagatcacttgagtacgaaccacacatgtaagtgcacgtatatttgagttctcaatacaattaccctgatgggcaagaacccacaggtgagagcagaggcttggttcccctagagggccctggctggaggccccaacaccaaccagacgacaggagggccagactgctacccagtactgtacctcctgctccttcaagagcctccctaagggagaagaagatctatacttccactttgtttgctgcacatgtggcaacaagattgctaccctgatttgggacacttgagagaacttgaaaaaaatgaccacccttaaagccctagaaaaaagttgtatgtttgttaacagctatgctgcgctcactttgcattgtgtgttcttgaaagctctgtataaatcaaaattttgacgacacactaaatacactagagaaatacactatagaggaatccttttatagggctgaagactcctttggtaagaaaaatatgctgcattaggggcagctgcaagtttactatttctggggaagaaaagatcaaagataagagccaggtttgttttttaaagcaatcaatccaaacagtttgggtgtttgttagttgttacccctgaggggcttgaggtgtaactatatcagctataaaaatagcaattccatacatttaattaggttactttatatctttcactcttccccatggctgtaataatggagattgaatgagactaaggctaagcccaactccactcaaatccaagtcacacgtcaccttggctgcagtacagggaagctccgcacaccctggcttgggaaagtttcggccgatggagcccaagatgcagggcaaccatctactctttagggttctgatgattccactccagaaaggtgcatgaagaggtccccgagctctgtcatgtcgacatcttcattgttggggacatgccggctttctcggttctcgatgaaatcccagagccgcactgaattaaagaact

SEQ ID NO: 361306 - DNA, 4830 bp, Homo sapiens
ggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgtatacacatgatgtgactagagaaacctgtattcctggcttccttgtatacacatgatgtgactacaaggaagccaggaatacaggttttcttgatgatttgggttttaattttgtttttattgcacctgacaaaatacagttatctgatggtccctcaattatgttattttaataaaataaattaaatttaggtgtaatggctggctgttacctccttttaaagtaattctgagctcacaacttgaatgccccatttgttcaccctcttcaggagcagaattcaagaacaggaaatgtgcccagagcctaggctgggaatgaatttgtaatttaacctttgtactctttgtaaacctctactgaagagttaagtataaaaattaattaagcagaaagtactctaaactcagctaataccttaagtaatacattttataaactatttatttatttggtaggtacagcttttttaaacacaaaaatagattagataaattccagcttggaacaagctagtgctggttcacaaggttatgctcacccttcaattaaaatcaaaatgactacaagacttgccatcagctctcttcaggaccactgctgggtcagaatcagaaaccttgggtgccatgaaatttttacaaaatttcaaatcaaagccaggctttgcagctagataatagatcacttgagtacgaaccacacatgtaagtgcacgtatatttgagttctcaatacaattaccctgatgggcaagaacccacaggtgagagcagaggcttggttcccctagagggccctggctggaggccccaacaccaaccagacgacaggagggccagactgctacccagtactgtacctcctgctccttcaagagcctccctaagggagaagaagatctatacttccactttgtttgctgcacatgtggcaacaagattgctaccctgatttgggacacttgagagaacttgaaaaaaatgaccacccttaaagccctagaaaaaagttgtatgtttgttaacagctatgctgcgctcactttgcattgtgtgttcttgaaagctctgtataaatcaaaattttgacgacacactaaatacactagagaaatacactatagaggaatccttttatagggctgaagactcctttggtaagaaaaatatgctgcattaggggcagctgcaagtttactatttctggggaagaaaagatcaaagataagagccaggtttgttttttaaagcaatcaatccaaacagtttgggtgtttgttagttgttacccctgaggggcttgaggtgtaactatatcagctataaaaatagcaattccatacatttaattaggttactttatatctttcactcttccccatggctgtaataatggagattgaatgagactaaggctaagcccaactccactcaaatccaagtcacacgtcaccttggctgcagtacagggaagctccgcacaccctggcttgggaaagtttcggccgatggagcccaagatgcagggcaaccatctactctttagggttctgatgattccactccagaaaggtgcatgaagaggtccccgagctctgtcatgtcgacatcttcattgttggggacatgccggctttctcggttctcgatgaaatcccagagccgcactgaattaaagaact

SEQ ID NO: 361307 - DNA, 3293 bp, Homo sapiens
  misc_feature (3250)..(3250): n is a, c, g, or t
  misc_feature (3252)..(3252): n is a, c, g, or t
  misc_feature (3254)..(3263): n is a, c, g, or t
  misc_feature (3277)..(3280): n is a, c, g, or t
ggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaaaaaaagngngnnnnnnnnnntttttttttttttnnnnttttttttttttt

SEQ ID NO: 361308 - DNA, 2667 bp, Homo sapiens
  misc_feature (2617)..(2617): n is a, c, g, or t
ggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattacttcctctaaatactcatgtagccaacagctggggctgggcatgctnttttgtactaccatcaacatccacttgcgcatctacagaaggctgggcct

SEQ ID NO: 361309 - DNA, 1883 bp, Homo sapiens
ccggttcacagagtctcggcagtcctgggctgtttggtgccttatgtgcaaatgtctggcgctgcaccactctctgaagaaagtcccgcctgtgacatgcattcctccagaagctgatttccaaaatcccatgtgtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaatggctggctgttacctccttttaaagtaattctgagctcacaacttgaatgccccatttgttcaccctcttcaggagcagaattcaagaacaggaaatgtgcccagagcctaggctgggaatgaatttgtaatttaacctttgtactctttgtaaacctctactgaagagttaagtataaaaattaattaagcagaaagtactctaaactcagctaataccttaagtaatacattttataaactatttatttatttggtaggtacagcttttttaaacacaaaaatagattagataaattccagcttggaacaagctagtgctggttcacaaggttatgctcacccttcaattaaaatcaaaatgactacaagacttgccatcagctctcttcaggaccactgctgggtcagaatcagaaaccttgggtgccatgaaatttttacaaaatttcaaatcaaagccaggctttgcagctagataatagatcacttgagtacgaaccacacatgtaagtgcacgtatatttgagttctcaatacaattaccctgatgggcaagaacccacaggtgagagcagaggcttggttcccctagagggccctggctggaggccccaacaccaaccagacgacaggagggccagactgctacccagtactgtacctcctgctccttcaagagcctccctaagggagaagaagatctatacttccactttgtttgctgcacatgtggcaacaagattgctaccctgatttgggacacttgagagaacttgaaaaaaatgaccacccttaaagccctagaaaaaagttgtatgtttgttaacagctatgctgcgctcactttgcattgtgtgttcttgaaagctctgtataaatcaaaattttgacgacacactaaatacactagagaaatacactatagaggaatccttttatagggctgaagactcctttggtaagaaaaatatgctgcattaggggcagctgcaagtttactatttctggggaagaaaagatcaaagataagagccaggtttgttttttaaagcaatcaatccaaacagtttgggtgtttgttagttgttacccctgaggggcttgaggtgtaactatatcagctataaaaatagcaattccatacatttaattaggttactttatatctttcactcttccccatggctgtaataatggagattgaatgagactaaggctaagcccaactccactcaaatccaagtcacacgtcaccttggctgcagtacagggaagctccgcacaccctggcttgggaaagtttcggccgatggagcccaagatgcagggcaaccatctactctttagggttctgatgattccactccagaaaggtgcatgaagaggtccccgagctctgtcatgtcgacatcttcattgttggggacatgccggctttctcggttctcgatgaaatcccagagccgcactgaattaaagaact

SEQ ID NO: 361310 - DNA, 894 bp, Homo sapiens
ggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaagggtaagagctcaaaagtcaattgacttcttcagactagtaaggatcttctagcttcaaatagctatgtttgtattaaattgtactagcttcctatagaatattgtatatttctatacctttctttataaagagataattcagaaaaataggtattaagaaattgaaattattgcttggacattctc

SEQ ID NO: 361311 - DNA, 760 bp, Homo sapiens
ggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtatgtgaacattctacttaggaaatttagctatttatctgcctgtggagcacattaaggatcatgttcaacttaaagacaggcaaaatattcattgtcatttagggtctttatttttttttttctaactgcagatttatttttttatattgcttgttccgctg

SEQ ID NO: 361312 - DNA, 338 bp, Homo sapiens
tttctactcatgcccctcaaacttatttttaataatttcttttcccttcacagctatttgcatgcaaagaacatcatccatagagacatgaaatccaacagtatcctttggttgttgagttcatttgactgctcggttctaaatttagggaaacagaagggaggctttctatcacaagtggctctcggtgccaggggatatctttttaaggaaagaggcagaggacaggaaaacagaaaagtcagaaaattagtaggcttggcctgtccctcagcagcttatgcctcacctggactgatgagagcgatgtttaggttaggttcctttctgagtttatc

SEQ ID NO: 361313 - DNA, 967 bp, Homo sapiens
ccacggggcaccataggcttagggtctgaggcctgtgtgtttaatcccgtacagatagatttacgatgcacgattaatgtggtcgtgcggtctgagccgtcgagaaatttactcgcgcatacttggtttccgtgatcctaagattgttggtaccgtaagaggaaaatcattgtgatggcgctaattaggtgtaagtctggcatgcctttcgagtgacccaggattaggctgaagtttggttcgagatctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaagggtaagagctcaaaagtcaattgacttcttcagactagtaaggatcttctagcttcaaatagctatgtttgtattaaattgtactagcttcctatagaatattgtatatttctatacctttctttataaagagataattcagaaaaataggtattaagaaattgaaattattgcttggacattctc

SEQ ID NO: 361314 - DNA, 4736 bp, Homo sapiens
ggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaatggctggctgttacctccttttaaagtaattctgagctcacaacttgaatgccccatttgttcaccctcttcaggagcagaattcaagaacaggaaatgtgcccagagcctaggctgggaatgaatttgtaatttaacctttgtactctttgtaaacctctactgaagagttaagtataaaaattaattaagcagaaagtactctaaactcagctaataccttaagtaatacattttataaactatttatttatttggtaggtacagcttttttaaacacaaaaatagattagataaattccagcttggaacaagctagtgctggttcacaaggttatgctcacccttcaattaaaatcaaaatgactacaagacttgccatcagctctcttcaggaccactgctgggtcagaatcagaaaccttgggtgccatgaaatttttacaaaatttcaaatcaaagccaggctttgcagctagataatagatcacttgagtacgaaccacacatgtaagtgcacgtatatttgagttctcaatacaattaccctgatgggcaagaacccacaggtgagagcagaggcttggttcccctagagggccctggctggaggccccaacaccaaccagacgacaggagggccagactgctacccagtactgtacctcctgctccttcaagagcctccctaagggagaagaagatctatacttccactttgtttgctgcacatgtggcaacaagattgctaccctgatttgggacacttgagagaacttgaaaaaaatgaccacccttaaagccctagaaaaaagttgtatgtttgttaacagctatgctgcgctcactttgcattgtgtgttcttgaaagctctgtataaatcaaaattttgacgacacactaaatacactagagaaatacactatagaggaatccttttatagggctgaagactcctttggtaagaaaaatatgctgcattaggggcagctgcaagtttactatttctggggaagaaaagatcaaagataagagccaggtttgttttttaaagcaatcaatccaaacagtttgggtgtttgttagttgttacccctgaggggcttgaggtgtaactatatcagctataaaaatagcaattccatacatttaattaggttactttatatctttcactcttccccatggctgtaataatggagattgaatgagactaaggctaagcccaactccactcaaatccaagtcacacgtcaccttggctgcagtacagggaagctccgcacaccctggcttgggaaagtttcggccgatggagcccaagatgcagggcaaccatctactctttagggttctgatgattccactccagaaaggtgcatgaagaggtccccgagctctgtcatgtcgacatcttcattgttggggacatgccggctttctcggttctcgatgaaatcccagagccgcactgaattaaagaact

SEQ ID NO: 361315 - DNA, 4682 bp, Homo sapiens
ggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaatggctggctgttacctccttttaaagtaattctgagctcacaacttgaatgccccatttgttcaccctcttcaggagcagaattcaagaacaggaaatgtgcccagagcctaggctgggaatgaatttgtaatttaacctttgtactctttgtaaacctctactgaagagttaagtataaaaattaattaagcagaaagtactctaaactcagctaataccttaagtaatacattttataaactatttatttatttggtaggtacagcttttttaaacacaaaaatagattagataaattccagcttggaacaagctagtgctggttcacaaggttatgctcacccttcaattaaaatcaaaatgactacaagacttgccatcagctctcttcaggaccactgctgggtcagaatcagaaaccttgggtgccatgaaatttttacaaaatttcaaatcaaagccaggctttgcagctagataatagatcacttgagtacgaaccacacatgtaagtgcacgtatatttgagttctcaatacaattaccctgatgggcaagaacccacaggtgagagcagaggcttggttcccctagagggccctggctggaggccccaacaccaaccagacgacaggagggccagactgctacccagtactgtacctcctgctccttcaagagcctccctaagggagaagaagatctatacttccactttgtttgctgcacatgtggcaacaagattgctaccctgatttgggacacttgagagaacttgaaaaaaatgaccacccttaaagccctagaaaaaagttgtatgtttgttaacagctatgctgcgctcactttgcattgtgtgttcttgaaagctctgtataaatcaaaattttgacgacacactaaatacactagagaaatacactatagaggaatccttttatagggctgaagactcctttggtaagaaaaatatgctgcattaggggcagctgcaagtttactatttctggggaagaaaagatcaaagataagagccaggtttgttttttaaagcaatcaatccaaacagtttgggtgtttgttagttgttacccctgaggggcttgaggtgtaactatatcagctataaaaatagcaattccatacatttaattaggttactttatatctttcactcttccccatggctgtaataatggagattgaatgagactaaggctaagcccaactccactcaaatccaagtcacacgtcaccttggctgcagtacagggaagctccgcacaccctggcttgggaaagtttcggccgatggagcccaagatgcagggcaaccatctactctttagggttctgatgattccactccagaaaggtgcatgaagaggtccccgagctctgtcatgtcgacatcttcattgttggggacatgccggctttctcggttctcgatgaaatcccagagccgcactgaattaaagaact

SEQ ID NO: 361316 - DNA, 4682 bp, Homo sapiens
ggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaatggctggctgttacctccttttaaagtaattctgagctcacaacttgaatgccccatttgttcaccctcttcaggagcagaattcaagaacaggaaatgtgcccagagcctaggctgggaatgaatttgtaatttaacctttgtactctttgtaaacctctactgaagagttaagtataaaaattaattaagcagaaagtactctaaactcagctaataccttaagtaatacattttataaactatttatttatttggtaggtacagcttttttaaacacaaaaatagattagataaattccagcttggaacaagctagtgctggttcacaaggttatgctcacccttcaattaaaatcaaaatgactacaagacttgccatcagctctcttcaggaccactgctgggtcagaatcagaaaccttgggtgccatgaaatttttacaaaatttcaaatcaaagccaggctttgcagctagataatagatcacttgagtacgaaccacacatgtaagtgcacgtatatttgagttctcaatacaattaccctgatgggcaagaacccacaggtgagagcagaggcttggttcccctagagggccctggctggaggccccaacaccaaccagacgacaggagggccagactgctacccagtactgtacctcctgctccttcaagagcctccctaagggagaagaagatctatacttccactttgtttgctgcacatgtggcaacaagattgctaccctgatttgggacacttgagagaacttgaaaaaaatgaccacccttaaagccctagaaaaaagttgtatgtttgttaacagctatggacgacacactaaatacactagagaaatacactatagaggaatccttttatagggctgaagactcctttggtaagaaaaatatgctgcattaggggcagctgcaagtttactatttctggggaagaaaagatcaaagataagagccaggtttgttttttaaagcaatcaatccaaacagtttgggtgtttgttagttgttacccctgaggggcttgaggtgtaactatatcagctataaaaatagcaattccatacatttaattaggttactttatatctttcactcttccccatggctgtaataatggagattgaatgagactaaggctaagcccaactccactcaaatccaagtcacacgtcaccttggctgcagtacagggaagctccgcacaccctggcttgggaaagtttcggccgatggagcccaagatgcagggcaaccatctactctttagggttctgatgattccactccagaaaggtgcatgaagaggtccccgagctctgtcatgtcgacatcttcattgttggggacatgccggctttctcggttctcgatgaaatcccagagccgcactgaattaaagaact

SEQ ID NO: 361317 - DNA, 4623 bp, Homo sapiens
ggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtgtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaatggctggctgttacctccttttaaagtaattctgagctcacaacttgaatgccccatttgttcaccctcttcaggagcagaattcaagaacaggaaatgtgcccagagcctaggctgggaatgaatttgtaatttaacctttgtactctttgtaaacctctactgaagagttaagtataaaaattaattaagcagaaagtactctaaactcagctaataccttaagtaatacattttataaactatttatttatttggtaggtacagcttttttaaacacaaaaatagattagataaattccagcttggaacaagctagtgctggttcacaaggttatgctcacccttcaattaaaatcaaaatgactacaagacttgccatcagctctcttcaggaccactgctgggtcagaatcagaaaccttgggtgccatgaaatttttacaaaatttcaaatcaaagccaggctttgcagctagataatagatcacttgagtacgaaccacacatgtaagtgcacgtatatttgagttctcaatacaattaccctgatgggcaagaacccacaggtgagagcagaggcttggttcccctagagggccctggctggaggccccaacaccaaccagacgacaggagggccagactgctacccagtactgtacctcctgctccttcaagagcctccctaagggagaagaagatctatacttccactttgtttgctgcacatgtggcaacaagattgctaccctgatttgggacacttgagagaacttgaaaaaaatgaccacccttaaagccctagaaaaaagttgtatgtttgttaacagctatgctgcgctcactttgcattgtgtgttcttgaaagctctgtataaatcaaaattttgacgacacactaaatacactagagaaatacactatagaggaatccttttatagggctgaagactcctttggtaagaaaaatatgctgcattaggggcagctgcaagtttactatttctggggaagaaaagatcaaagataagagccaggtttgttttttaaagcaatcaatccaaacagtttgggtgtttgttagttgttacccctgaggggcttgaggtgtaactatatcagctataaaaatagcaattccatacatttaattaggttactttatatctttcactcttccccatggctgtaataatggagattgaatgagactaaggctaagcccaactccactcaaatccaagtcacacgtcaccttggctgcagtacagggaagctccgcacaccctggcttgggaaagtttcggccgatggagcccaagatgcagggcaaccatctactctttagggttctgatgattccactccagaaaggtgcatgaagaggtccccgagctctgtcatgtcgacatcttcattgttggggacatgccggctttctcggttctcgatgaaatcccagagccgcactgaattaaagaact

SEQ ID NO: 361318 - DNA, 3610 bp, Homo sapiens
aggtgggcagaaataggccctatttttacctgtatttcccagaaccctttttgttatagctgagttgccttattttagacttcagaacagtcagctttccaatctttcagtcactatttagacttgtaggaataagtcatataatggagacttctacaaggagtccttgtgacctccacaggagggtcatggagtgtacattgatgaaagagaatgtcctctctgtaagcaaggctggcactgaactgatggcccagtgaactaatggtgggcttctgtttgctcagaatgccacccgggttatcagccgtgccatgtgtttgtttttgggactgggggtggtgttgggactgggggtggtgtcgacagcacagaacccactgtccacgggaaagcacagtagacctccctgagcactttcctcctccctctcctctcttcccctcccctccccagcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaatggctggctgttacctccttttaaagtaattctgagctcacaacttgaatgccccatttgttcaccctcttcaggagcagaattcaagaacaggaaatgtgcccagagcctaggctgggaatgaatttgtaatttaacctttgtactctttgtaaacctctactgaagagttaagtataaaaattaattaagcagaaagtactctaaactcagctaataccttaagtaatacattttataaactatttatttatttggtaggtacagcttttttaaacacaaaaatagattagataaattccagcttggaacaagctagtgctggttcacaaggttatgctcacccttcaattaaaatcaaaatgactacaagacttgccatcagctctcttcaggaccactgctgggtcagaatcagaaaccttgggtgccatgaaatttttacaaaatttcaaatcaaagccaggctttgcagctagataatagatcacttgagtacgaaccacacatgtaagtgcacgtatatttgagttctcaatacaattaccctgatgggcaagaacccacaggtgagagcagaggcttggttcccctagagggccctggctggaggccccaacaccaaccagacgacaggagggccagactgctacccagtactgtacctcctgctccttcaagagcctccctaagggagaagaagatctatacttccactttgtttgctgcacatgtggcaacaagattgctaccctgatttgggacacttgagagaacttgaaaaaaatgaccacccttaaagccctagaaaaaagttgtatgtttgttaacagctatgctgcgctcactttgcattgtgtgttcttgaaagctctgtataaatcaaaattttgacgacacactaaatacactagagaaatacactatagaggaatccttttatagggctgaagactcctttggtaagaaaaatatgctgcattaggggcagctgcaagtttactatttctggggaagaaaagatcaaagataagagccaggtttgttttttaaagcaatcaatccaaacagtttgggtgtttgttagttgttacccctgaggggcttgaggtgtaactatatcagctataaaaatagcaattccatacatttaattaggttactttatatctttcactcttccccatggctgtaataatggagattgaatgagactaaggctaagcccaactccactcaaatccaagtcacacgtcaccttggctgcagtacagggaagctccgcacaccctggcttgggaaagtttcggccgatggagcccaagatgcagggcaaccatctactctttagggttctgatgattccactccagaaaggtgcatgaagaggtccccgagctctgtcatgtcgacatcttcattgttggggacatgccggctttctcggttctcgatgaaatcccagagccgcactgaattaaagaact

SEQ ID NO: 361319 - DNA, 2526 bp, Homo sapiens
  misc_feature (143)..(143): n is a, c, g, or t
  misc_feature (186)..(186): n is a, c, g, or t
  misc_feature (351)..(351): n is a, c, g, or t
  misc_feature (354)..(354): n is a, c, g, or t
ttttttttgtctcttggtggttccttgagggctttgatgatcagggcagaggcagaaggcaccacctcaatctgggcctgtctgttctgaatggtcagtttcactgtaatcctcaggcccttccagtcaccccgttgccttgnaactgtcatcaccaactttttttggagacagacccaggggccngatcttgggggccagggcagaagtggcaccgacttcacctccggtcacctcaggtatacgactttgatctcgttggggtcgaacttcggcggcatggtggaggcggctggtgtcggatgaacccggattcgggacgaccgaagaaagttctcgtgccgaattcgnaangcattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaatggctggctgttacctccttttaaagtaattctgagctcacaacttgaatgccccatttgttcaccctcttcaggagcagaattcaagaacaggaaatgtgcccagagcctaggctgggaatgaatttgtaatttaacctttgtactctttgtaaacctctactgaagagttaagtataaaaattaattaagcagaaagtactctaaactcagctaataccttaagtaatacattttataaactatttatttatttggtaggtacagcttttttaaacacaaaaatagattagataaattccagcttggaacaagctagtgctggttcacaaggttatgctcacccttcaattaaaatcaaaatgactacaagacttgccatcagctctcttcaggaccactgctgggtcagaatcagaaaccttgggtgccatgaaatttttacaaaatttcaaatcaaagccaggctttgcagctagataatagatcacttgagtacgaaccacacatgtaagtgcacgtatatttgagttctcaatacaattaccctgatgggcaagaacccacaggtgagagcagaggcttggttcccctagagggccctggctggaggccccaacaccaaccagacgacaggagggccagactgctacccagtactgtacctcctgctccttcaagagcctccctaagggagaagaagatctatacttccactttgtttgctgcacatgtggcaacaagattgctaccctgatttgggacacttgagagaacttgaaaaaaatgaccacccttaaagccctagaaaaaagttgtatgtttgttaacagctatgctgcgctcactttgcattgtgtgttcttgaaagctctgtataaatcaaaattttgacgacacactaaatacactagagaaatacactatagaggaatccttttatagggctgaagactcctttggtaagaaaaatatgctgcattaggggcagctgcaagtttactatttctggggaagaaaagatcaaagataagagccaggtttgttttttaaagcaatcaatccaaacagtttgggtgtttgttagttgttacccctgaggggcttgaggtgtaactatatcagctataaaaatagcaattccatacatttaattaggttactttatatctttcactcttccccatggctgtaataatggagattgaatgagactaaggctaagcccaactccactcaaatccaagtcacacgtcaccttggctgcagtacagggaagctccgcacaccctggcttgggaaagtttcggccgatggagcccaagatgcagggcaaccatctactctttagggttctgatgattccactccagaaaggtgcatgaagaggtccccgagctctgtcatgtcgacatcttcattgttggggacatgccggctttctcggttctcgatgaaatcccagagccgcactgaattaaagaact

SEQ ID NO: 361320 - DNA, 3335 bp, Homo sapiens
ggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgtatacacatgatgtgactagagaaacctgtattcctggcttccttgtatacacatgatgtgactacaaggaagccaggaatacaggttttcttgatgatttgggttttaattttgtttttattgcacctgacaaaatacagttatctgatggtccctcaattatgttattttaataaaataaattaaattt

SEQ ID NO: 361321 - DNA, 2550 bp, Homo sapiens
ggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgcaggttgaacaacctactggctctgtcctctggatggtgagaatctgggctcccaccagcagtctctggtatagggcaaaaggaatgccttggagatttatgtgcaaacttaaagcgtttctgtacatttccccgaaatccacatgacccctagtgacagccagcctcagggcaattgtagattttcttgaggaagctgttgatcagaaccactgtgaagcttagtgtggagaggagttaataagctgggtgacagaaatgctgggtcttggtcctttaaagacaaggattcctgagctgttttaaccagtgcctgagttggagtcctttgggggaaaagctatgtggggactgaagaatggactcattcataactaatgaaagggacagcctggcccctagatgtctgtgaggcctgtcatatggtgataaatgcacttttgtcatatggtgatacatgtaggccccagaggtgatccgaatgcaggataacaacccattcagtttccagtcggatgtctactcctatggcatcgtattgtatgaactgatgacgggggagcttccttattctcacatcaacaaccgagatcaggtaagtctgtgctggtgcgaaaggacccaactcgtgggagccccctgggcctccgccagcctaagcagctagaagggttaggacttgttattatctgttgttcattcaccccccattagc

SEQ ID NO: 361322 - DNA, 4143 bp, Homo sapiens
  misc_feature (1679)..(1679): n is a, c, g, or t
  misc_feature (2392)..(2392): n is a, c, g, or t
  misc_feature (2430)..(2430): n is a, c, g, or t
  misc_feature (2914)..(2914): n is a, c, g, or t
  misc_feature (2920)..(2920): n is a, c, g, or t
  misc_feature (2945)..(2945): n is a, c, g, or t
cccattgtctctcgctgacgcgtcggagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagttatgtattctcattttgcccaagacctttggtcagagcagagcataaaagattctttccaaaaagtgatactaagaagatatgaaaaatgtagacatgacaatttacagttaaaaaaaggctgtgaaagtgtagatgagtgtccagtgcacaaaagaggttataatggacttaaacaatgtttggcaactacccagagaaaaatatttcaatgtgatgaatatgtgaaattcttgcataaattttcaaattcaaacaaacataagataagagatactggaaaaaaatcttttaaatgtatagaatatgggaaaacttttaaccagtcttcaacccgtactacatataagaaaattgatgctggagagaaacgctataaatgtgaagaatgtggtaaagcctataagcagtcctcacaccttactacacataagaaaattcatactggagagaaaccctacaaatgtgaagaatgtggcaaagcctataagcagtcctgtaaccttactacacataagataattcatactggagagaaaccctacagatgtagagaatgtggcaaagcttttaaccaccctgcaacccttttttcacataagaaaattcatactggagagaaaccatacaagtgtgataaatgtggcaaagcctttatttcatcctcaacccttactaaacatgagataattcatactggagagaaaccctacaaatgtgaggaatgtggcaaagcttttaaccgttcctcaaaccttactaaacataagagaattcatactggagatgtaccctacaaatgtgacgaatgtggcaaaacctttacctggtactcaagcctctctaaacataagagagctcatactggagagaaaccctacaagtgtgaagaatgtggcaaagcctttactgcattctcaactctaactgaacataagataattcatactggagagaaaccgtacaaatgtgaagaatgtggcaaagcttttaactggtcctcagcccttaataaacataagaaaattcatattagacagaaaccctgcatagtgaagaatgtggaaaatcttttaaatgttcctcaacccttaataagcataagataattcatactggagagaaaccgtatgaatgtgatgaatgtgggaaagcctttaactagccctggactctgactaaatatgagaatttatatggaacataaaccctacaaatataaagaatgtgacaaagctttttaaggaagttctcaacccttattacacataatttatactggacagaaaccctacaagtgngaagaatatggcaaagcctataacaacctgtcaactctttttgttttttgagatggagtttcactcttgtcacccaggctggagtgcaatggcacgatctcagctcactgcaacttctgcctcctggtatcaagccattctcctgcctcagcctcccgagtagctgggattactggtgcccaccaccatgcccagctaatttttgtatttttagtagagatggggtttcatcatgtttgccagactggtctccaactcctgacctcagatggtccacccacctcggcatcctaaagtgctgagatgacaggcatgagccacgacgcccagccacaagttctcaattcttaagagacatggcgataattcatgctgaagaggaactctacaaacctgaaagatgcaacagtgcttttaccaccacctccaacttttgtatacataaaaataaattatactaatgtgaaaccctggaaatgtatgaaatgagacaaagcgtttatatggttgccacacttgattgtagatggagtctcggtctttcacccaggctggagcgctgtggcacgatctcggctcactgcaacctccacctcccaggttcacaccattctcctgcctcagcttcctgagtagctgggactgcaggcacccgccaccatgcccggctaatttttttgtatttttagtagagatggggtttcactgtgttngccgggatggtcaatctcctgaccttgtgatccgcccnccttggccctccaaagtgctgggattacaggcgtgagccaccgcacctggccattatgccactaactttaacctatcccaccttaatcaagggtgtacttaaaagatggtaacaatatactgtttggtacgtagtggaataacatctctacttgtcactttgccagtggctttaaactgcaaatgagttgaattgttcccatagcttaaattttttttcttattgaaatctattactagtatttgtgggtatacagtatgtgtatatctttatgccttatatggcatattttgattcaggcctacaatatgtagtaattacattagggtaaagtatccatcacctctagcatttatcctttgaattacagtgtaattatacatttttaattattttaaaatgtacaattaaattgttactgactacaggtttatttttatggtcataataaaaattatacagaaaaataaataaaatatggccnggtgcngtggctcaggcctgtaatcccagcnctttccaaggcaggtggattgtctgaggtcaggagttcaagaccatcctggccaacatagtgaaaccccgtctgaggaagcgctcctttcgcgggggcactcgctgtggatgaataaagtacactgacacacattctgctctgccagtccagctgagggtccgagccgcttacaggctccaaggccaggcacggtggctcatgcctataattccagcactttggagggccaaggcaggcggatcatctgaggtcaggagttcacgcaaatcagggggcccgtgaaaggcaactgagcagggatccatgggaaagacaccctcagaggcacaagattctctcgttacctttcagtttgctgatacttcagttaaagtctcctgggaaacgtctgcattaggttcttcctctgtagttcttcttaccttgcctgtaaaacaaaacctatctagtgtctgcataggtttccacttcttgtccccacctgaggaatggaaagcaacggcacagtccttgctcatgttttggagtgaaaggagcttgaaggtcatgtgagctttgccaaggcttctcctggcctcatgtcagatacagctcctaactcccaagcagcctaccatagtgtcctcctttttttgcgtgtgtgatggggtttcgcacttgttgcccaggctggagtgcaatggtacaatctcggctcactgcaacctccgcctcccaggttcaagtgattcttctgcctcagcctctcaagtaactgggattacaggcatgcgccactaagggaggagaccactcctcatattgtcttatgcccaatttctgcttccaaagaaagaagaagtaaaaactaaaaggcagaaatgaaatccacaggcagacagcccagcgccacaccatgggcctggtagttaaagatcgagccctgacctaatcggttatgttatctacagattacagacattgtatagaaaagcactttgaaaatccctgtcctgttctgttccattctaattactggtgcatgcagccttcagtcacttactccctgcttgctcaatcgatcacgaccctctcatgcaaacccccttagagttgtaagcccttaagagggataggaattgctcactcagggagctcagtttttgagacgtgagtcttgccaatgctcccggccgaataaagcccttccttcttta

SEQ ID NO: 361323 - DNA, 1046 bp, Homo sapiens
cccattgtctctcgctgacgcgtcggagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccaggtggtctatgaagaggaatgttttatgagctattgagaaggctatgtatcctgatgatgttgaggagtgttctctataccttcattagaaataattgttttttactgccttctagtcctctgttcccttactaatatactgtcttgttttattattattacagaaagtggggtattgaaatatcctactataattatattgctctattcaactttgttagtatttgctttatatatttgaaaccccaatttgagacacacacacgcacaaatacacacatggatcaacaaatttgtcataggtttccatgaattaatctatatattgtttaatgtccttcttttttgaagttttaacttaaagtacattttataaaatatgacagcttttgactttaacaatgtagcttgtgtaatattattttgacctcttctgctctcattttgttagtatttacatgaaatttctacttggtcttgccactttcagtcttttcttatcattagatctcagctgactcttgtaaaaaggcaagttgagtcttgatttttaaaattttttaatgagcctttttagaagtatgtctcttgattggaaagataattatatttaaatagttttctgaaagagaaaaacttactgttaataaaataattgttttgattctt

SEQ ID NO: 361324 - DNA, 322 bp, Homo sapiens
ctgtttttatttcttcaaaaatacaatgagaaatttgaaaaatattgcattaaatctataggttaaattgagcggtatagacatcttcacaatattaattatttcctttttgattgtttttgagatggagttaaattcacccgcctcggcctcccaaagtgctggggtaacaggcatgagccaccgcacccagcctgaaacaggtttttaatcctgtctacgtgagtagtcataaaaattctcctaatttcaacatctatttatttatgaatctatattatttttgtgtgggggaaacacataacaaaatgtgttatctgtc

SEQ ID NO: 361325 - DNA, 5492 bp, Homo sapiens
  misc_feature (1679)..(1679): n is a, c, g, or t
  misc_feature (3741)..(3741): n is a, c, g, or t
  misc_feature (3779)..(3779): n is a, c, g, or t
  misc_feature (4263)..(4263): n is a, c, g, or t
  misc_feature (4269)..(4269): n is a, c, g, or t
  misc_feature (4294)..(4294): n is a, c, g, or t
cccattgtctctcgctgacgcgtcggagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagttatgtattctcattttgcccaagacctttggtcagagcagagcataaaagattctttccaaaaagtgatactaagaagatatgaaaaatgtagacatgacaatttacagttaaaaaaaggctgtgaaagtgtagatgagtgtccagtgcacaaaagaggttataatggacttaaacaatgtttggcaactacccagagaaaaatatttcaatgtgatgaatatgtgaaattcttgcataaattttcaaattcaaacaaacataagataagagatactggaaaaaaatcttttaaatgtatagaatatgggaaaacttttaaccagtcttcaacccgtactacatataagaaaattgatgctggagagaaacgctataaatgtgaagaatgtggtaaagcctataagcagtcctcacaccttactacacataagaaaattcatactggagagaaaccctacaaatgtgaagaatgtggcaaagcctataagcagtcctgtaaccttactacacataagataattcatactggagagaaaccctacagatgtagagaatgtggcaaagcttttaaccaccctgcaacccttttttcacataagaaaattcatactggagagaaaccatacaagtgtgataaatgtggcaaagcctttatttcatcctcaacccttactaaacatgagataattcatactggagagaaaccctacaaatgtgaggaatgtggcaaagcttttaaccgttcctcaaaccttactaaacataagagaattcatactggagatgtaccctacaaatgtgacgaatgtggcaaaacctttacctggtactcaagcctctctaaacataagagagctcatactggagagaaaccctacaagtgtgaagaatgtggcaaagcctttactgcattctcaactctaactgaacataagataattcatactggagagaaaccgtacaaatgtgaagaatgtggcaaagcttttaactggtcctcagcccttaataaacataagaaaattcatattagacagaaaccctgcatagtgaagaatgtggaaaatcttttaaatgttcctcaacccttaataagcataagataattcatactggagagaaaccgtatgaatgtgatgaatgtgggaaagcctttaactagccctggactctgactaaatatgagaatttatatggaacataaaccctacaaatataaagaatgtgacaaagctttttaaggaagttctcaacccttattacacataatttatactggacagaaaccctacaagtgngaagaatatggcaaagcctataacaacctgtcaactctttttgttttttgagatggagtttcactcttgtcacccaggctggagtgcaatggcacgatctcagctcactgcaacttctgcctcctggtatcaagccattctcctgcctcagcctcccgagtagctgggattactggtgcccaccaccatgcccagctaatttttgtatttttagtagagatggggtttcatcatgtttgccagactggtctccaactcctgacctcagatggtccacccacctcggcatcctaaagtgctgagatgacaggcatgagccacgacgcccagccacaagttctcaattcttaagagacatggcgataattcatgctgaagaggaactctacaaacctgaaagatgcaacagtgcttttaccaccacctccaacttttgtatacataaaaataaattatactaatgtgaaaccctggaaatgtatgaaatgagacaaagcgtttatatggttgccacacttgattgtaggtaagagaattaatgctgccaaaactcctacaagtgtgaagaatgtggcaaaacttttgagtgcttacaccttatttcacaggaaagcttttatccttgagaaaaatcgtacagatataaagaatatggaaacgccattaacgcccactcacatctcaacagaaggttcatagttaataaaagcaataaaagtgcaattactgtcaaaaaatctttcagaaaatataagcctttaaagaagaatatttattctgaaatcagctattacaaatataagggggggttgtagtacctttacttgtatcacagatcttgttgcacacattgtgtactagaggaaaacctgaagcagttgctccagctttattcaacaacatggaatttatattggagaagagtcctgcaaatataatgaatttggaaagactttttttttcaaaatctatagcttagaaaacatcagagagtttatactaaagtatatttttgcagatgtaaatatgaaaaaaatatttaattcaaaattgattttacgtaaatatgagaatttacactagaataaggcactgacacttcagacattacactaaatcagagtattgagtataaaaatgaatccacaactaaagctgtttttgtatataactttaaaagggagattttctgaagcattgtaatttcattgaaagtgtacttgtttcttgaaaaaaatttttgaacagtgaataatgatgtaatacaactttcaaatttctttacgctgttattttattcctattgtggtcacatgtgaaagcatgtgatcaattgttgctgcatcagggatattacagattcttttttattgggtattatgaccttttctataaaagaataaggacattaaaatgtaagatgcatgataaaaatgtaagtggagaggctctttgtagttaacttatattaagtaatgtataaggtgggggttctcatttgtataatcctagcctatgacttaatgttgatgttttgctttgtcttttggatggcctaacctacattaacatgttggcagaccattttaaaacttttttttttcaaaaattataatgaattactttattaataaagatttttaaaaagtgggggttcagagtaatagttttctacattatagtgagaaaaattacagttaaaagtattaaatgagaatattattttactaattgtacttttatgtaatcgaatgcagtatatttaaaaattgttagatgatgtgtgaacttaatttcattttttataccatgttaagactattctgcgtttaatgaagcattattatgccactaactttttttctttttttttgaatggagtctcggtctttcacccaggctggagcgctgtggcacgatctcggctcactgcaacctccacctcccaggttcacaccattctcctgcctcagcttcctgagtagctgggactgcaggcacccgccaccatgcccggctaatttttttgtatttttagtagagatggggtttcactgtgttngccgggatggtcaatctcctgaccttgtgatccgcccnccttggccctccaaagtgctgggattacaggcgtgagccaccgcacctggccattatgccactaactttaacctatcccaccttaatcaagggtgtacttaaaagatggtaacaatatactgtttggtacgtagtggaataacatctctacttgtcactttgccagtggctttaaactgcaaatgagttgaattgttcccatagcttaaattttttttcttattgaaatctattactagtatttgtgggtatacagtatgtgtatatctttatgccttatatggcatattttgattcaggcctacaatatgtagtaattacattagggtaaagtatccatcacctctagcatttatcctttgaattacagtgtaattatacatttttaattattttaaaatgtacaattaaattgttactgactacaggtttatttttatggtcataataaaaattatacagaaaaataaataaaatatggccnggtgcngtggctcaggcctgtaatcccagcnctttccaaggcaggtggattgtctgaggtcaggagttcaagaccatcctggccaacatagtgaaaccccgtctgaggaagcgctcctttcgcgggggcactcgctgtggatgaataaagtacactgacacacattctgctctgccagtccagctgagggtccgagccgcttacaggctccaaggccaggcacggtggctcatgcctataattccagcactttggagggccaaggcaggcggatcatctgaggtcaggagttcacgcaaatcagggggcccgtgaaaggcaactgagcagggatccatgggaaagacaccctcagaggcacaagattctctcgttacctttcagtttgctgatacttcagttaaagtctcctgggaaacgtctgcattaggttcttcctctgtagttcttcttaccttgcctgtaaaacaaaacctatctagtgtctgcataggtttccacttcttgtccccacctgaggaatggaaagcaacggcacagtccttgctcatgttttggagtgaaaggagcttgaaggtcatgtgagctttgccaaggcttctcctggcctcatgtcagatacagctcctaactcccaagcagcctaccatagtgtcctcctttttttgcgtgtgtgatggggtttcgcacttgttgcccaggctggagtgcaatggtacaatctcggctcactgcaacctccgcctcccaggttcaagtgattcttctgcctcagcctctcaagtaactgggattacaggcatgcgccactaagggaggagaccactcctcatattgtcttatgcccaatttctgcttccaaagaaagaagaagtaaaaactaaaaggcagaaatgaaatccacaggcagacagcccagcgccacaccatgggcctggtagttaaagatcgagccctgacctaatcggttatgttatctacagattacagacattgtatagaaaagcactttgaaaatccctgtcctgttctgttccattctaattactggtgcatgcagccttcagtcacttactccctgcttgctcaatcgatcacgaccctctcatgcaaacccccttagagttgtaagcccttaagagggataggaattgctcactcagggagctcagtttttgagacgtgagtcttgccaatgctcccggccgaataaagcccttccttcttta

SEQ ID NO: 361326 - DNA, 3329 bp, Homo sapiens
  misc_feature (1679)..(1679): n is a, c, g, or t
cccattgtctctcgctgacgcgtcggagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagttatgtattctcattttgcccaagacctttggtcagagcagagcataaaagattctttccaaaaagtgatactaagaagatatgaaaaatgtagacatgacaatttacagttaaaaaaaggctgtgaaagtgtagatgagtgtccagtgcacaaaagaggttataatggacttaaacaatgtttggcaactacccagagaaaaatatttcaatgtgatgaatatgtgaaattcttgcataaattttcaaattcaaacaaacataagataagagatactggaaaaaaatcttttaaatgtatagaatatgggaaaacttttaaccagtcttcaacccgtactacatataagaaaattgatgctggagagaaacgctataaatgtgaagaatgtggtaaagcctataagcagtcctcacaccttactacacataagaaaattcatactggagagaaaccctacaaatgtgaagaatgtggcaaagcctataagcagtcctgtaaccttactacacataagataattcatactggagagaaaccctacagatgtagagaatgtggcaaagcttttaaccaccctgcaacccttttttcacataagaaaattcatactggagagaaaccatacaagtgtgataaatgtggcaaagcctttatttcatcctcaacccttactaaacatgagataattcatactggagagaaaccctacaaatgtgaggaatgtggcaaagcttttaaccgttcctcaaaccttactaaacataagagaattcatactggagatgtaccctacaaatgtgacgaatgtggcaaaacctttacctggtactcaagcctctctaaacataagagagctcatactggagagaaaccctacaagtgtgaagaatgtggcaaagcctttactgcattctcaactctaactgaacataagataattcatactggagagaaaccgtacaaatgtgaagaatgtggcaaagcttttaactggtcctcagcccttaataaacataagaaaattcatattagacagaaaccctgcatagtgaagaatgtggaaaatcttttaaatgttcctcaacccttaataagcataagataattcatactggagagaaaccgtatgaatgtgatgaatgtgggaaagcctttaactagccctggactctgactaaatatgagaatttatatggaacataaaccctacaaatataaagaatgtgacaaagctttttaaggaagttctcaacccttattacacataatttatactggacagaaaccctacaagtgngaagaatatggcaaagcctataacaacctgtcaactctttttgttttttgagatggagtttcactcttgtcacccaggctggagtgcaatggcacgatctcagctcactgcaacttctgcctcctggtatcaagccattctcctgcctcagcctcccgagtagctgggattactggtgcccaccaccatgcccagctaatttttgtatttttagtagagatggggtttcatcatgtttgccagactggtctccaactcctgacctcagatggtccacccacctcggcatcctaaagtgctgagatgacaggcatgagccacgacgcccagccacaagttctcaattcttaagagacatggcgataattcatgctgaagaggaactctacaaacctgaaagatgcaacagtgcttttaccaccacctccaacttttgtatacataaaaataaattatactaatgtgaaaccctggaaatgtatgaaatgagacaaagcgtttatatggttgccacacttgattgtaggtaagagaattaatgctgccaaaactcctacaagtgtgaagaatgtggcaaaacttttgagtgcttacaccttatttcacaggaaagcttttatccttgagaaaaatcgtacagatataaagaatatggaaacgccattaacgcccactcacatctcaacagaaggttcatagttaataaaagcaataaaagtgcaattactgtcaaaaaatctttcagaaaatataagcctttaaagaagaatatttattctgaaatcagctattacaaatataagggggggttgtagtacctttacttgtatcacagatcttgttgcacacattgtgtactagaggaaaacctgaagcagttgctccagctttattcaacaacatggaatttatattggagaagagtcctgcaaatataatgaatttggaaagactttttttttcaaaatctatagcttagaaaacatcagagagtttatactaaagtatatttttgcagatgtaaatatgaaaaaaatatttaattcaaaattgattttacgtaaatatgagaatttacactagaataaggcactgacacttcagacattacactaaatcagagtattgagtataaaaatgaatccacaactaaagctgtttttgtatataactttaaaagggagattttctgaagcattgtaatttcattgaaagtgtacttgtttcttgaaaaaaatttttgaacagtgaataatgatgtaatacaactttcaaatttctttacgctgttattttattcctattgtggtcacatgtgaaagcatgtgatcaattgttgctgcatcagggatattacagattcttttttattgggtattatgaccttttctataaaagaataaggacattaaaatgtaagatgcatgataaaaatgtaagtggagaggctctttgtagttaacttatattaagtaatgtataaggtgggggttctcatttgtataatcctagcctatgacttaatgttgatgttttgctttgtcttttggatggcctaacctacattaacatgttggcagaccattttaaaacttttttttttcaaaaattataatgaattactttattaataaagatttttaaaaagtg

SEQ ID NO: 361327 - DNA, 5364 bp, Homo sapiens
  misc_feature (1551)..(1551): n is a, c, g, or t
  misc_feature (3613)..(3613): n is a, c, g, or t
  misc_feature (3651)..(3651): n is a, c, g, or t
  misc_feature (4135)..(4135): n is a, c, g, or t
  misc_feature (4141)..(4141): n is a, c, g, or t
  misc_feature (4166)..(4166): n is a, c, g, or t
tctatgtggctctttgcattgtgctcacctggagccctttacacacttaactaatttataaattttttacaaatgtattttggtcagtatgtttttgttacagttatatatccaggaagaaattacagcttgtggtattttgctgtgtcatcttgcttacgtagtttgtataattttataggttagatttgtgaagtatatttatctgagtctagcaattgaagtcatgtgtttttattgtttctttcagttatgtattctcattttgcccaagacctttggtcagagcagagcataaaagattctttccaaaaagtgatactaagaagatatgaaaaatgtagacatgacaatttacagttaaaaaaaggctgtgaaagtgtagatgagtgtccagtgcacaaaagaggttataatggacttaaacaatgtttggcaactacccagagaaaaatatttcaatgtgatgaatatgtgaaattcttgcataaattttcaaattcaaacaaacataagataagagatactggaaaaaaatcttttaaatgtatagaatatgggaaaacttttaaccagtcttcaacccgtactacatataagaaaattgatgctggagagaaacgctataaatgtgaagaatgtggtaaagcctataagcagtcctcacaccttactacacataagaaaattcatactggagagaaaccctacaaatgtgaagaatgtggcaaagcctataagcagtcctgtaaccttactacacataagataattcatactggagagaaaccctacagatgtagagaatgtggcaaagcttttaaccaccctgcaacccttttttcacataagaaaattcatactggagagaaaccatacaagtgtgataaatgtggcaaagcctttatttcatcctcaacccttactaaacatgagataattcatactggagagaaaccctacaaatgtgaggaatgtggcaaagcttttaaccgttcctcaaaccttactaaacataagagaattcatactggagatgtaccctacaaatgtgacgaatgtggcaaaacctttacctggtactcaagcctctctaaacataagagagctcatactggagagaaaccctacaagtgtgaagaatgtggcaaagcctttactgcattctcaactctaactgaacataagataattcatactggagagaaaccgtacaaatgtgaagaatgtggcaaagcttttaactggtcctcagcccttaataaacataagaaaattcatattagacagaaaccctgcatagtgaagaatgtggaaaatcttttaaatgttcctcaacccttaataagcataagataattcatactggagagaaaccgtatgaatgtgatgaatgtgggaaagcctttaactagccctggactctgactaaatatgagaatttatatggaacataaaccctacaaatataaagaatgtgacaaagctttttaaggaagttctcaacccttattacacataatttatactggacagaaaccctacaagtgngaagaatatggcaaagcctataacaacctgtcaactctttttgttttttgagatggagtttcactcttgtcacccaggctggagtgcaatggcacgatctcagctcactgcaacttctgcctcctggtatcaagccattctcctgcctcagcctcccgagtagctgggattactggtgcccaccaccatgcccagctaatttttgtatttttagtagagatggggtttcatcatgtttgccagactggtctccaactcctgacctcagatggtccacccacctcggcatcctaaagtgctgagatgacaggcatgagccacgacgcccagccacaagttctcaattcttaagagacatggcgataattcatgctgaagaggaactctacaaacctgaaagatgcaacagtgcttttaccaccacctccaacttttgtatacataaaaataaattatactaatgtgaaaccctggaaatgtatgaaatgagacaaagcgtttatatggttgccacacttgattgtaggtaagagaattaatgctgccaaaactcctacaagtgtgaagaatgtggcaaaacttttgagtgcttacaccttatttcacaggaaagcttttatccttgagaaaaatcgtacagatataaagaatatggaaacgccattaacgcccactcacatctcaacagaaggttcatagttaataaaagcaataaaagtgcaattactgtcaaaaaatctttcagaaaatataagcctttaaagaagaatatttattctgaaatcagctattacaaatataagggggggttgtagtacctttacttgtatcacagatcttgttgcacacattgtgtactagaggaaaacctgaagcagttgctccagctttattcaacaacatggaatttatattggagaagagtcctgcaaatataatgaatttggaaagactttttttttcaaaatctatagcttagaaaacatcagagagtttatactaaagtatatttttgcagatgtaaatatgaaaaaaatatttaattcaaaattgattttacgtaaatatgagaatttacactagaataaggcactgacacttcagacattacactaaatcagagtattgagtataaaaatgaatccacaactaaagctgtttttgtatataactttaaaagggagattttctgaagcattgtaatttcattgaaagtgtacttgtttcttgaaaaaaatttttgaacagtgaataatgatgtaatacaactttcaaatttctttacgctgttattttattcctattgtggtcacatgtgaaagcatgtgatcaattgttgctgcatcagggatattacagattcttttttattgggtattatgaccttttctataaaagaataaggacattaaaatgtaagatgcatgataaaaatgtaagtggagaggctctttgtagttaacttatattaagtaatgtataaggtgggggttctcatttgtataatcctagcctatgacttaatgttgatgttttgctttgtcttttggatggcctaacctacattaacatgttggcagaccattttaaaacttttttttttcaaaaattataatgaattactttattaataaagatttttaaaaagtgggggttcagagtaatagttttctacattatagtgagaaaaattacagttaaaagtattaaatgagaatattattttactaattgtacttttatgtaatcgaatgcagtatatttaaaaattgttagatgatgtgtgaacttaatttcattttttataccatgttaagactattctgcgtttaatgaagcattattatgccactaactttttttctttttttttgaatggagtctcggtctttcacccaggctggagcgctgtggcacgatctcggctcactgcaacctccacctcccaggttcacaccattctcctgcctcagcttcctgagtagctgggactgcaggcacccgccaccatgcccggctaatttttttgtatttttagtagagatggggtttcactgtgttngccgggatggtcaatctcctgaccttgtgatccgcccnccttggccctccaaagtgctgggattacaggcgtgagccaccgcacctggccattatgccactaactttaacctatcccaccttaatcaagggtgtacttaaaagatggtaacaatatactgtttggtacgtagtggaataacatctctacttgtcactttgccagtggctttaaactgcaaatgagttgaattgttcccatagcttaaattttttttcttattgaaatctattactagtatttgtgggtatacagtatgtgtatatctttatgccttatatggcatattttgattcaggcctacaatatgtagtaattacattagggtaaagtatccatcacctctagcatttatcctttgaattacagtgtaattatacatttttaattattttaaaatgtacaattaaattgttactgactacaggtttatttttatggtcataataaaaattatacagaaaaataaataaaatatggccnggtgcngtggctcaggcctgtaatcccagcnctttccaaggcaggtggattgtctgaggtcaggagttcaagaccatcctggccaacatagtgaaaccccgtctgaggaagcgctcctttcgcgggggcactcgctgtggatgaataaagtacactgacacacattctgctctgccagtccagctgagggtccgagccgcttacaggctccaaggccaggcacggtggctcatgcctataattccagcactttggagggccaaggcaggcggatcatctgaggtcaggagttcacgcaaatcagggggcccgtgaaaggcaactgagcagggatccatgggaaagacaccctcagaggcacaagattctctcgttacctttcagtttgctgatacttcagttaaagtctcctgggaaacgtctgcattaggttcttcctctgtagttcttcttaccttgcctgtaaaacaaaacctatctagtgtctgcataggtttccacttcttgtccccacctgaggaatggaaagcaacggcacagtccttgctcatgttttggagtgaaaggagcttgaaggtcatgtgagctttgccaaggcttctcctggcctcatgtcagatacagctcctaactcccaagcagcctaccatagtgtcctcctttttttgcgtgtgtgatggggtttcgcacttgttgcccaggctggagtgcaatggtacaatctcggctcactgcaacctccgcctcccaggttcaagtgattcttctgcctcagcctctcaagtaactgggattacaggcatgcgccactaagggaggagaccactcctcatattgtcttatgcccaatttctgcttccaaagaaagaagaagtaaaaactaaaaggcagaaatgaaatccacaggcagacagcccagcgccacaccatgggcctggtagttaaagatcgagccctgacctaatcggttatgttatctacagattacagacattgtatagaaaagcactttgaaaatccctgtcctgttctgttccattctaattactggtgcatgcagccttcagtcacttactccctgcttgctcaatcgatcacgaccctctcatgcaaacccccttagagttgtaagcccttaagagggataggaattgctcactcagggagctcagtttttgagacgtgagtcttgccaatgctcccggccgaataaagcccttccttcttta

SEQ ID NO: 361328 - DNA, 4956 bp, Homo sapiens
  misc_feature (1679)..(1679): n is a, c, g, or t
  misc_feature (3741)..(3741): n is a, c, g, or t
  misc_feature (3779)..(3779): n is a, c, g, or t
  misc_feature (4263)..(4263): n is a, c, g, or t
  misc_feature (4269)..(4269): n is a, c, g, or t
  misc_feature (4294)..(4294): n is a, c, g, or t
cccattgtctctcgctgacgcgtcggagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagttatgtattctcattttgcccaagacctttggtcagagcagagcataaaagattctttccaaaaagtgatactaagaagatatgaaaaatgtagacatgacaatttacagttaaaaaaaggctgtgaaagtgtagatgagtgtccagtgcacaaaagaggttataatggacttaaacaatgtttggcaactacccagagaaaaatatttcaatgtgatgaatatgtgaaattcttgcataaattttcaaattcaaacaaacataagataagagatactggaaaaaaatcttttaaatgtatagaatatgggaaaacttttaaccagtcttcaacccgtactacatataagaaaattgatgctggagagaaacgctataaatgtgaagaatgtggtaaagcctataagcagtcctcacaccttactacacataagaaaattcatactggagagaaaccctacaaatgtgaagaatgtggcaaagcctataagcagtcctgtaaccttactacacataagataattcatactggagagaaaccctacagatgtagagaatgtggcaaagcttttaaccaccctgcaacccttttttcacataagaaaattcatactggagagaaaccatacaagtgtgataaatgtggcaaagcctttatttcatcctcaacccttactaaacatgagataattcatactggagagaaaccctacaaatgtgaggaatgtggcaaagcttttaaccgttcctcaaaccttactaaacataagagaattcatactggagatgtaccctacaaatgtgacgaatgtggcaaaacctttacctggtactcaagcctctctaaacataagagagctcatactggagagaaaccctacaagtgtgaagaatgtggcaaagcctttactgcattctcaactctaactgaacataagataattcatactggagagaaaccgtacaaatgtgaagaatgtggcaaagcttttaactggtcctcagcccttaataaacataagaaaattcatattagacagaaaccctgcatagtgaagaatgtggaaaatcttttaaatgttcctcaacccttaataagcataagataattcatactggagagaaaccgtatgaatgtgatgaatgtgggaaagcctttaactagccctggactctgactaaatatgagaatttatatggaacataaaccctacaaatataaagaatgtgacaaagctttttaaggaagttctcaacccttattacacataatttatactggacagaaaccctacaagtgngaagaatatggcaaagcctataacaacctgtcaactctttttgttttttgagatggagtttcactcttgtcacccaggctggagtgcaatggcacgatctcagctcactgcaacttctgcctcctggtatcaagccattctcctgcctcagcctcccgagtagctgggattactggtgcccaccaccatgcccagctaatttttgtatttttagtagagatggggtttcatcatgtttgccagactggtctccaactcctgacctcagatggtccacccacctcggcatcctaaagtgctgagatgacaggcatgagccacgacgcccagccacaagttctcaattcttaagagacatggcgataattcatgctgaagaggaactctacaaacctgaaagatgcaacagtgcttttaccaccacctccaacttttgtatacataaaaataaattatactaatgtgaaaccctggaaatgtatgaaatgagacaaagcgtttatatggttgccacacttgattgtaggtaagagaattaatgctgccaaaactcctacaagtgtgaagaatgtggcaaaacttttgagtgcttacaccttatttcacaggaaagcttttatccttgagaaaaatcgtacagatataaagaatatggaaacgccattaacgcccactcacatctcaacagaaggttcatagttaataaaagcaataaaagtgcaattactgtcaaaaaatctttcagaaaatataagcctttaaagaagaatatttattctgaaatcagctattacaaatataagggggggttgtagtacctttacttgtatcacagatcttgttgcacacattgtgtactagaggaaaacctgaagcagttgctccagctttattcaacaacatggaatttatattggagaagagtcctgcaaatataatgaatttggaaagactttttttttcaaaatctatagcttagaaaacatcagagagtttatactaaagtatatttttgcagatgtaaatatgaaaaaaatatttaattcaaaattgattttacgtaaatatgagaatttacactagaataaggcactgacacttcagacattacactaaatcagagtattgagtataaaaatgaatccacaactaaagctgtttttgtatataactttaaaagggagattttctgaagcattgtaatttcattgaaagtgtacttgtttcttgaaaaaaatttttgaacagtgaataatgatgtaatacaactttcaaatttctttacgctgttattttattcctattgtggtcacatgtgaaagcatgtgatcaattgttgctgcatcagggatattacagattcttttttattgggtattatgaccttttctataaaagaataaggacattaaaatgtaagatgcatgataaaaatgtaagtggagaggctctttgtagttaacttatattaagtaatgtataaggtgggggttctcatttgtataatcctagcctatgacttaatgttgatgttttgctttgtcttttggatggcctaacctacattaacatgttggcagaccattttaaaacttttttttttcaaaaattataatgaattactttattaataaagatttttaaaaagtgggggttcagagtaatagttttctacattatagtgagaaaaattacagttaaaagtattaaatgagaatattattttactaattgtacttttatgtaatcgaatgcagtatatttaaaaattgttagatgatgtgtgaacttaatttcattttttataccatgttaagactattctgcgtttaatgaagcattattatgccactaactttttttctttttttttgaatggagtctcggtctttcacccaggctggagcgctgtggcacgatctcggctcactgcaacctccacctcccaggttcacaccattctcctgcctcagcttcctgagtagctgggactgcaggcacccgccaccatgcccggctaatttttttgtatttttagtagagatggggtttcactgtgttngccgggatggtcaatctcctgaccttgtgatccgcccnccttggccctccaaagtgctgggattacaggcgtgagccaccgcacctggccattatgccactaactttaacctatcccaccttaatcaagggtgtacttaaaagatggtaacaatatactgtttggtacgtagtggaataacatctctacttgtcactttgccagtggctttaaactgcaaatgagttgaattgttcccatagcttaaattttttttcttattgaaatctattactagtatttgtgggtatacagtatgtgtatatctttatgccttatatggcatattttgattcaggcctacaatatgtagtaattacattagggtaaagtatccatcacctctagcatttatcctttgaattacagtgtaattatacatttttaattattttaaaatgtacaattaaattgttactgactacaggtttatttttatggtcataataaaaattatacagaaaaataaataaaatatggccnggtgcngtggctcaggcctgtaatcccagcnctttccaaggcaggtggattgtctgaggtcaggagttcaagaccatcctggccaacatagtgaaaccccgtctgaggaagcgctcctttcgcgggggcactcgctgtggatgaataaagtacactgacacacattctgctctgccagtccagctgagggtccgagccgcttacaggctccaaggccaggcacggtggctcatgcctataattccagcactttggagggccaaggcaggcggatcatctgaggtcaggagttcacgcaaatcagggggcccaatttctgcttccaaagaaagaagaagtaaaaactaaaaggcagaaatgaaatccacaggcagacagcccagcgccacaccatgggcctggtagttaaagatcgagccctgacctaatcggttatgttatctacagattacagacattgtatagaaaagcactttgaaaatccctgtcctgttctgttccattctaattactggtgcatgcagccttcagtcacttactccctgcttgctcaatcgatcacgaccctctcatgcaaacccccttagagttgtaagcccttaagagggataggaattgctcactcagggagctcagtttttgagacgtgagtcttgccaatgctcccggccgaataaagcccttccttcttta

SEQ ID NO: 361329 - DNA, 4930 bp, Homo sapiens
  misc_feature (1679)..(1679): n is a, c, g, or t
  misc_feature (3741)..(3741): n is a, c, g, or t
  misc_feature (3779)..(3779): n is a, c, g, or t
  misc_feature (4263)..(4263): n is a, c, g, or t
  misc_feature (4269)..(4269): n is a, c, g, or t
  misc_feature (4294)..(4294): n is a, c, g, or t
cccattgtctctcgctgacgcgtcggagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagttatgtattctcattttgcccaagacctttggtcagagcagagcataaaagattctttccaaaaagtgatactaagaagatatgaaaaatgtagacatgacaatttacagttaaaaaaaggctgtgaaagtgtagatgagtgtccagtgcacaaaagaggttataatggacttaaacaatgtttggcaactacccagagaaaaatatttcaatgtgatgaatatgtgaaattcttgcataaattttcaaattcaaacaaacataagataagagatactggaaaaaaatcttttaaatgtatagaatatgggaaaacttttaaccagtcttcaacccgtactacatataagaaaattgatgctggagagaaacgctataaatgtgaagaatgtggtaaagcctataagcagtcctcacaccttactacacataagaaaattcatactggagagaaaccctacaaatgtgaagaatgtggcaaagcctataagcagtcctgtaaccttactacacataagataattcatactggagagaaaccctacagatgtagagaatgtggcaaagcttttaaccaccctgcaacccttttttcacataagaaaattcatactggagagaaaccatacaagtgtgataaatgtggcaaagcctttatttcatcctcaacccttactaaacatgagataattcatactggagagaaaccctacaaatgtgaggaatgtggcaaagcttttaaccgttcctcaaaccttactaaacataagagaattcatactggagatgtaccctacaaatgtgacgaatgtggcaaaacctttacctggtactcaagcctctctaaacataagagagctcatactggagagaaaccctacaagtgtgaagaatgtggcaaagcctttactgcattctcaactctaactgaacataagataattcatactggagagaaaccgtacaaatgtgaagaatgtggcaaagcttttaactggtcctcagcccttaataaacataagaaaattcatattagacagaaaccctgcatagtgaagaatgtggaaaatcttttaaatgttcctcaacccttaataagcataagataattcatactggagagaaaccgtatgaatgtgatgaatgtgggaaagcctttaactagccctggactctgactaaatatgagaatttatatggaacataaaccctacaaatataaagaatgtgacaaagctttttaaggaagttctcaacccttattacacataatttatactggacagaaaccctacaagtgngaagaatatggcaaagcctataacaacctgtcaactctttttgttttttgagatggagtttcactcttgtcacccaggctggagtgcaatggcacgatctcagctcactgcaacttctgcctcctggtatcaagccattctcctgcctcagcctcccgagtagctgggattactggtgcccaccaccatgcccagctaatttttgtatttttagtagagatggggtttcatcatgtttgccagactggtctccaactcctgacctcagatggtccacccacctcggcatcctaaagtgctgagatgacaggcatgagccacgacgcccagccacaagttctcaattcttaagagacatggcgataattcatgctgaagaggaactctacaaacctgaaagatgcaacagtgcttttaccaccacctccaacttttgtatacataaaaataaattatactaatgtgaaaccctggaaatgtatgaaatgagacaaagcgtttatatggttgccacacttgattgtaggtaagagaattaatgctgccaaaactcctacaagtgtgaagaatgtggcaaaacttttgagtgcttacaccttatttcacaggaaagcttttatccttgagaaaaatcgtacagatataaagaatatggaaacgccattaacgcccactcacatctcaacagaaggttcatagttaataaaagcaataaaagtgcaattactgtcaaaaaatctttcagaaaatataagcctttaaagaagaatatttattctgaaatcagctattacaaatataagggggggttgtagtacctttacttgtatcacagatcttgttgcacacattgtgtactagaggaaaacctgaagcagttgctccagctttattcaacaacatggaatttatattggagaagagtcctgcaaatataatgaatttggaaagactttttttttcaaaatctatagcttagaaaacatcagagagtttatactaaagtatatttttgcagatgtaaatatgaaaaaaatatttaattcaaaattgattttacgtaaatatgagaatttacactagaataaggcactgacacttcagacattacactaaatcagagtattgagtataaaaatgaatccacaactaaagctgtttttgtatataactttaaaagggagattttctgaagcattgtaatttcattgaaagtgtacttgtttcttgaaaaaaatttttgaacagtgaataatgatgtaatacaactttcaaatttctttacgctgttattttattcctattgtggtcacatgtgaaagcatgtgatcaattgttgctgcatcagggatattacagattcttttttattgggtattatgaccttttctataaaagaataaggacattaaaatgtaagatgcatgataaaaatgtaagtggagaggctctttgtagttaacttatattaagtaatgtataaggtgggggttctcatttgtataatcctagcctatgacttaatgttgatgttttgctttgtcttttggatggcctaacctacattaacatgttggcagaccattttaaaacttttttttttcaaaaattataatgaattactttattaataaagatttttaaaaagtgggggttcagagtaatagttttctacattatagtgagaaaaattacagttaaaagtattaaatgagaatattattttactaattgtacttttatgtaatcgaatgcagtatatttaaaaattgttagatgatgtgtgaacttaatttcattttttataccatgttaagactattctgcgtttaatgaagcattattatgccactaactttttttctttttttttgaatggagtctcggtctttcacccaggctggagcgctgtggcacgatctcggctcactgcaacctccacctcccaggttcacaccattctcctgcctcagcttcctgagtagctgggactgcaggcacccgccaccatgcccggctaatttttttgtatttttagtagagatggggtttcactgtgttngccgggatggtcaatctcctgaccttgtgatccgcccnccttggccctccaaagtgctgggattacaggcgtgagccaccgcacctggccattatgccactaactttaacctatcccaccttaatcaagggtgtacttaaaagatggtaacaatatactgtttggtacgtagtggaataacatctctacttgtcactttgccagtggctttaaactgcaaatgagttgaattgttcccatagcttaaattttttttcttattgaaatctattactagtatttgtgggtatacagtatgtgtatatctttatgccttatatggcatattttgattcaggcctacaatatgtagtaattacattagggtaaagtatccatcacctctagcatttatcctttgaattacagtgtaattatacatttttaattattttaaaatgtacaattaaattgttactgactacaggtttatttttatggtcataataaaaattatacagaaaaataaataaaatatggccnggtgcngtggctcaggcctgtaatcccagcnctttccaaggcaggtggattgtctgaggtcaggagttcaagaccatcctggccaacatagtgaaaccccgtctgaggaagcgctcctttcgcgggggcactcgctgtggatgaataaagtacactgacacacattctgctctgccagtccagctgagggtccgagccgcttacaggctccaaggtgagttctgtaaacagttgcaacttggctctgatcagatagtgaggcttgcatttattcagtaagactaattaacaaaagttgtgagtaaacaccactagagggtaaaattaaaggccaggttcccaggcctaaagcaaacaccatttgtgggtaataaactgcggacccccgagtaggcggcagtaaagtaccctcagcaggacaaaagttagtcttaagcccatataactaaacaggttagtaagataaacttcctacattccttttcacttgcaccctaatcttcctggcctcctgcaaagagaccctggctgccttcagccaagcaatcaagctatgcaaactctcaggccttttaggacagcttttgactgttactcttttaaatatttttcccaccagcctgattgaaccccaacacccagctctactaaaaacacaaaaattagc

SEQ ID NO: 361330 - DNA, 3941 bp, Homo sapiens
  misc_feature (1679)..(1679): n is a, c, g, or t
cccattgtctctcgctgacgcgtcggagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagttatgtattctcattttgcccaagacctttggtcagagcagagcataaaagattctttccaaaaagtgatactaagaagatatgaaaaatgtagacatgacaatttacagttaaaaaaaggctgtgaaagtgtagatgagtgtccagtgcacaaaagaggttataatggacttaaacaatgtttggcaactacccagagaaaaatatttcaatgtgatgaatatgtgaaattcttgcataaattttcaaattcaaacaaacataagataagagatactggaaaaaaatcttttaaatgtatagaatatgggaaaacttttaaccagtcttcaacccgtactacatataagaaaattgatgctggagagaaacgctataaatgtgaagaatgtggtaaagcctataagcagtcctcacaccttactacacataagaaaattcatactggagagaaaccctacaaatgtgaagaatgtggcaaagcctataagcagtcctgtaaccttactacacataagataattcatactggagagaaaccctacagatgtagagaatgtggcaaagcttttaaccaccctgcaacccttttttcacataagaaaattcatactggagagaaaccatacaagtgtgataaatgtggcaaagcctttatttcatcctcaacccttactaaacatgagataattcatactggagagaaaccctacaaatgtgaggaatgtggcaaagcttttaaccgttcctcaaaccttactaaacataagagaattcatactggagatgtaccctacaaatgtgacgaatgtggcaaaacctttacctggtactcaagcctctctaaacataagagagctcatactggagagaaaccctacaagtgtgaagaatgtggcaaagcctttactgcattctcaactctaactgaacataagataattcatactggagagaaaccgtacaaatgtgaagaatgtggcaaagcttttaactggtcctcagcccttaataaacataagaaaattcatattagacagaaaccctgcatagtgaagaatgtggaaaatcttttaaatgttcctcaacccttaataagcataagataattcatactggagagaaaccgtatgaatgtgatgaatgtgggaaagcctttaactagccctggactctgactaaatatgagaatttatatggaacataaaccctacaaatataaagaatgtgacaaagctttttaaggaagttctcaacccttattacacataatttatactggacagaaaccctacaagtgngaagaatatggcaaagcctataacaacctgtcaactctttttgttttttgagatggagtttcactcttgtcacccaggctggagtgcaatggcacgatctcagctcactgcaacttctgcctcctggtatcaagccattctcctgcctcagcctcccgagtagctgggattactggtgcccaccaccatgcccagctaatttttgtatttttagtagagatggggtttcatcatgtttgccagactggtctccaactcctgacctcagatggtccacccacctcggcatcctaaagtgctgagatgacaggcatgagccacgacgcccagccacaagttctcaattcttaagagacatggcgataattcatgctgaagaggaactctacaaacctgaaagatgcaacagtgcttttaccaccacctccaacttttgtatacataaaaataaattatactaatgtgaaaccctggaaatgtatgaaatgagacaaagcgtttatatggttgccacacttgattgtaggtaagagaattaatgctgccaaaactcctacaagtgtgaagaatgtggcaaaacttttgagtgcttacaccttatttcacaggaaagcttttatccttgagaaaaatcgtacagatataaagaatatggaaacgccattaacgcccactcacatctcaacagaaggttcatagttaataaaagcaataaaagtgcaattactgtcaaaaaatctttcagaaaatataagcctttaaagaagaatatttattctgaaatcagctattacaaatataagggggggttgtagtacctttacttgtatcacagatcttgttgcacacattgtgtactagaggaaaacctgaagcagttgctccagctttattcaacaacatggaatttatattggagaagagtcctgcaaatataatgaatttggaaagactttttttttcaaaatctatagcttagaaaacatcagagagtttatactaaagtatatttttgcagatgtaaatatgaaaaaaatatttaattcaaaattgattttacgtaaatatgagaatttacactagaataaggcactgacacttcagacattacactaaatcagagtattgagtataaaaatgaatccacaactaaagctgtttttgtatataactttaaaagggagattttctgaagcattgtaatttcattgaaagtgtacttgtttcttgaaaaaaatttttgaacagtgaataatgatgtaatacaactttcaaatttctttacgctgttattttattcctattgtggtcacatgtgaaagcatgtgatcaattgttgctgcatcagggatattacagattcttttttattgggtattatgaccttttctataaaagaataaggacattaaaatgtaagatgcatgataaaaatgtaagtggagaggctctttgtagttaacttatattaagtaatgtataaggtgggggttctcatttgtataatcctagcctatgacttaatgttgatgttttgctttgtcttttggatggcctaacctacattaacatgttggcagaccattttaaaacttttttttttcaaaaattataatgaattactttattaataaagatttttaaaaagtgggggttcagagtaatagttttctacattatagtgagaaaaattacagttaaaagtattaaatgagaatattattttactaattgtacttttatgtaatcgaatgcagtatatttaaaaattgttagatgatgtgtgaacttaatttcattttttataccatgttaagactattctgcgtttaatgaagcattattatgccactaactttttttctttttttttgactgagatcacgccactgcattccagtctgggcaacagagcaagactctatttcaaaaaaaaacaaagaaatagaaatagaatccatgtatttctgaatcctgaaaaattattagtaaatgtttattatatagttttctttgaacatctggtctgtctgcaaacatatagaccttttttttttttttttttgagatggagtcttgctctgtccccaggctggagtgcagtggcgtgatctcagctcccgggatcgagtggttctcctacctcagcctcccgaatagctgggactacaggcatgtgccaccatgcttagctaatttttgtatttttagtagggatgggctgtcaccatgttggcaaggatggtctcgatctcttgacct

SEQ ID NO: 361331 - DNA, 3318 bp, Homo sapiens
  misc_feature (1679)..(1679): n is a, c, g, or t
cccattgtctctcgctgacgcgtcggagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagttatgtattctcattttgcccaagacctttggtcagagcagagcataaaagattctttccaaaaagtgatactaagaagatatgaaaaatgtagacatgacaatttacagttaaaaaaaggctgtgaaagtgtagatgagtgtccagtgcacaaaagaggttataatggacttaaacaatgtttggcaactacccagagaaaaatatttcaatgtgatgaatatgtgaaattcttgcataaattttcaaattcaaacaaacataagataagagatactggaaaaaaatcttttaaatgtatagaatatgggaaaacttttaaccagtcttcaacccgtactacatataagaaaattgatgctggagagaaacgctataaatgtgaagaatgtggtaaagcctataagcagtcctcacaccttactacacataagaaaattcatactggagagaaaccctacaaatgtgaagaatgtggcaaagcctataagcagtcctgtaaccttactacacataagataattcatactggagagaaaccctacagatgtagagaatgtggcaaagcttttaaccaccctgcaacccttttttcacataagaaaattcatactggagagaaaccatacaagtgtgataaatgtggcaaagcctttatttcatcctcaacccttactaaacatgagataattcatactggagagaaaccctacaaatgtgaggaatgtggcaaagcttttaaccgttcctcaaaccttactaaacataagagaattcatactggagatgtaccctacaaatgtgacgaatgtggcaaaacctttacctggtactcaagcctctctaaacataagagagctcatactggagagaaaccctacaagtgtgaagaatgtggcaaagcctttactgcattctcaactctaactgaacataagataattcatactggagagaaaccgtacaaatgtgaagaatgtggcaaagcttttaactggtcctcagcccttaataaacataagaaaattcatattagacagaaaccctgcatagtgaagaatgtggaaaatcttttaaatgttcctcaacccttaataagcataagataattcatactggagagaaaccgtatgaatgtgatgaatgtgggaaagcctttaactagccctggactctgactaaatatgagaatttatatggaacataaaccctacaaatataaagaatgtgacaaagctttttaaggaagttctcaacccttattacacataatttatactggacagaaaccctacaagtgngaagaatatggcaaagcctataacaacctgtcaactctttttgttttttgagatggagtttcactcttgtcacccaggctggagtgcaatggcacgatctcagctcactgcaacttctgcctcctggtatcaagccattctcctgcctcagcctcccgagtagctgggattactggtgcccaccaccatgcccagctaatttttgtatttttagtagagatggggtttcatcatgtttgccagactggtctccaactcctgacctcagatggtccacccacctcggcatcctaaagtgctgagatgacaggcatgagccacgacgcccagccacaagttctcaattcttaagagacatggcgataattcatgctgaagaggaactctacaaacctgaaagatgcaacagtgcttttaccaccacctccaacttttgtatacataaaaataaattatactaatgtgaaaccctggaaatgtatgaaatgagacaaagcgtttatatggttgccacacttgattgtaggtaagagaattaatgctgccaaaactcctacaagtgtgaagaatgtggcaaaacttttgagtgcttacaccttatttcacaggaaagcttttatccttgagaaaaatcgtacagatataaagaatatggaaacgccattaacgcccactcacatctcaacagaaggttcatagttaataaaagcaataaaagtgcaattactgtcaaaaaatctttcagaaaatataagcctttaaagaagaatatttattctgaaatcagctattacaaatataagggggggttgtagtacctttacttgtatcacagatcttgttgcacacattgtgtactagaggaaaacctgaagcagttgctccagctttattcaacaacatggaatttatattggagaagagtcctgcaaatataatgaatttggaaagactttttttttcaaaatctatagcttagaaaacatcagagagtttatactaaagtatatttttgcagatgtaaatatgaaaaaaatatttaattcaaaattgattttacgtaaatatgagaatttacactagaataaggcactgacacttcagacattacactaaatcagagtattgagtataaaaatgaatccacaactaaagctgtttttgtatataactttaaaagggagattttctgaagcattgtaatttcattgaaagtgtacttgtttcttgaaaaaaatttttgaacagtgaataatgatgtaatacaactttcaaatttctttacgctgttattttattcctattgtggtcacatgtgaaagcatgtgatcaattgttgctgcatcagggatattacagattcttttttattgggtattatgaccttttctataaaagaataaggacattaaaatgtaagatgcatgataaaaatgtaagtggagaggctctttgtagttaacttatattaagtaatgtataaggtgggggttctcatttgtataatcctagcctatgacttaatgttgatgttttgctttgtcttttggatggcctaacctacattaacatgttggcagaccatccaaaagacaaagcaaaacatcagatataagtcgctgacttgaagcaacatatt

SEQ ID NO: 361332 - DNA, 1649 bp, Homo sapiens
gtattttttagtagagacggggtttctccatgttggtcagcctggtctcgacctcctgacctcaagtgatccacccgcctcggcctcccaaagtgctgggattacaggcatgagccaccatgcctggccaattctgcaggtttgaaaggggtccatggattggcttcattcacagctaatgctgaccctacttgccctagatcacttatagcagcactcaactagacaaagtgccacagcacacagttccttaaacctatactcttctcacaacataaatgctttcagtccaaaataaaaaccaccaatcactatcctaaaacatggcacactctgctggtcctttaaactttacagaggctggagaaggcagctcatgtctgagtaagtctgcatttggaaaacaacatgcacacatgcgttaatgcaatgtttatggagcatgctctgtgtgctcagaagcacgctacggagctgggaagatgacatgaatttatccttataataccctgggaggtgggtactaactgtcccataattccctggatttatatgaaaagcccagcatttacatttcttcttgttctcactgattttttttaatttttttatttttttttaatgcatggaacaggccaggcacggtggctcatgcctataattccagcactttggagggccaaggcaggcggatcatctgaggtcaggagttcacgcaaatcagggggcccgtgaaaggcaactgagcagggatccatgggaaagacaccctcagaggcacaagattctctcgttacctttcagtttgctgatacttcagttaaagtctcctgggaaacgtctgcattaggttcttcctctgtagttcttcttaccttgcctgtaaaacaaaacctatctagtgtctgcataggtttccacttcttgtccccacctgaggaatggaaagcaacggcacagtccttgctcatgttttggagtgaaaggagcttgaaggtcatgtgagctttgccaaggcttctcctggcctcatgtcagatacagctcctaactcccaagcagcctaccatagtgtcctcctttttttgcgtgtgtgatggggtttcgcacttgttgcccaggctggagtgcaatggtacaatctcggctcactgcaacctccgcctcccaggttcaagtgattcttctgcctcagcctctcaagtaactgggattacaggcatgcgccactaagggaggagaccactcctcatattgtcttatgcccaatttctgcttccaaagaaagaagaagtaaaaactaaaaggcagaaatgaaatccacaggcagacagcccagcgccacaccatgggcctggtagttaaagatcgagccctgacctaatcggttatgttatctacagattacagacattgtatagaaaagcactttgaaaatccctgtcctgttctgttccattctaattactggtgcatgcagccttcagtcacttactccctgcttgctcaatcgatcacgaccctctcatgcaaacccccttagagttgtaagcccttaagagggataggaattgctcactcagggagctcagtttttgagacgtgagtcttgccaatgctcccggccgaataaagcccttccttcttta

SEQ ID NO: 361333 - DNA, 1787 bp, Homo sapiens
  misc_feature (558)..(558): n is a, c, g, or t
  misc_feature (564)..(564): n is a, c, g, or t
  misc_feature (589)..(589): n is a, c, g, or t
gcccacggtagattgcccacggtagattgcccacggtagattgcgtgaactcctgacctcagatgacccgcctgccttggccctccaaagtgctgggattacaggcgtgagccaccgcacctggccattatgccactaactttaacctatcccaccttaatcaagggtgtacttaaaagatggtaacaatatactgtttggtacgtagtggaataacatctctacttgtcactttgccagtggctttaaactgcaaatgagttgaattgttcccatagcttaaattttttttcttattgaaatctattactagtatttgtgggtatacagtatgtgtatatctttatgccttatatggcatattttgattcaggcctacaatatgtagtaattacattagggtaaagtatccatcacctctagcatttatcctttgaattacagtgtaattatacatttttaattattttaaaatgtacaattaaattgttactgactacaggtttatttttatggtcataataaaaattatacagaaaaataaataaaatatggccnggtgcngtggctcaggcctgtaatcccagcnctttccaaggcaggtggattgtctgaggtcaggagttcaagaccatcctggccaacatagtgaaaccccgtctgaggaagcgctcctttcgcgggggcactcgctgtggatgaataaagtacactgacacacattctgctctgccagtccagctgagggtccgagccgcttacaggctccaaggccaggcacggtggctcatgcctataattccagcactttggagggccaaggcaggcggatcatctgaggtcaggagttcacgcaaatcagggggcccgtgaaaggcaactgagcagggatccatgggaaagacaccctcagaggcacaagattctctcgttacctttcagtttgctgatacttcagttaaagtctcctgggaaacgtctgcattaggttcttcctctgtagttcttcttaccttgcctgtaaaacaaaacctatctagtgtctgcataggtttccacttcttgtccccacctgaggaatggaaagcaacggcacagtccttgctcatgttttggagtgaaaggagcttgaaggtcatgtgagctttgccaaggcttctcctggcctcatgtcagatacagctcctaactcccaagcagcctaccatagtgtcctcctttttttgcgtgtgtgatggggtttcgcacttgttgcccaggctggagtgcaatggtacaatctcggctcactgcaacctccgcctcccaggttcaagtgattcttctgcctcagcctctcaagtaactgggattacaggcatgcgccactaagggaggagaccactcctcatattgtcttatgcccaatttctgcttccaaagaaagaagaagtaaaaactaaaaggcagaaatgaaatccacaggcagacagcccagcgccacaccatgggcctggtagttaaagatcgagccctgacctaatcggttatgttatctacagattacagacattgtatagaaaagcactttgaaaatccctgtcctgttctgttccattctaattactggtgcatgcagccttcagtcacttactccctgcttgctcaatcgatcacgaccctctcatgcaaacccccttagagttgtaagcccttaagagggataggaattgctcactcagggagctcagtttttgagacgtgagtcttgccaatgctcccggccgaataaagcccttccttcttta

SEQ ID NO: 361334 - DNA, 1464 bp, Homo sapiens
cccattgtctctcgctgacgcgtcggagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagatggagtctcggtctttcacccaggctggagcgctgtggcacgatctcggctcactgcaacctccacctccgccaggcacggtggctcatgcctataattccagcactttggagggccaaggcaggcggatcatctgaggtcaggagttcacgcaaatcagggggcccgtgaaaggcaactgagcagggatccatgggaaagacaccctcagaggcacaagattctctcgttacctttcagtttgctgatacttcagttaaagtctcctgggaaacgtctgcattaggttcttcctctgtagttcttcttaccttgcctgtaaaacaaaacctatctagtgtctgcataggtttccacttcttgtccccacctgaggaatggaaagcaacggcacagtccttgctcatgttttggagtgaaaggagcttgaaggtcatgtgagctttgccaaggcttctcctggcctcatgtcagatacagctcctaactcccaagcagcctaccatagtgtcctcctttttttgcgtgtgtgatggggtttcgcacttgttgcccaggctggagtgcaatggtacaatctcggctcactgcaacctccgcctcccaggttcaagtgattcttctgcctcagcctctcaagtaactgggattacaggcatgcgccactaagggaggagaccactcctcatattgtcttatgcccaatttctgcttccaaagaaagaagaagtaaaaactaaaaggcagaaatgaaatccacaggcagacagcccagcgccacaccatgggcctggtagttaaagatcgagccctgacctaatcggttatgttatctacagattacagacattgtatagaaaagcactttgaaaatccctgtcctgttctgttccattctaattactggtgcatgcagccttcagtcacttactccctgcttgctcaatcgatcacgaccctctcatgcaaacccccttagagttgtaagcccttaagagggataggaattgctcactcagggagctcagtttttgagacgtgagtcttgccaatgctcccggccgaataaagcccttccttcttta

SEQ ID NO: 361335 - DNA, 1336 bp, Homo sapiens
cccattgtctctcgctgacgcgtcggagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactataattccagcactttggagggccaaggcaggcggatcatctgaggtcaggagttcacgcaaatcagggggcccgtgaaaggcaactgagcagggatccatgggaaagacaccctcagaggcacaagattctctcgttacctttcagtttgctgatacttcagttaaagtctcctgggaaacgtctgcattaggttcttcctctgtagttcttcttaccttgcctgtaaaacaaaacctatctagtgtctgcataggtttccacttcttgtccccacctgaggaatggaaagcaacggcacagtccttgctcatgttttggagtgaaaggagcttgaaggtcatgtgagctttgccaaggcttctcctggcctcatgtcagatacagctcctaactcccaagcagcctaccatagtgtcctcctttttttgcgtgtgtgatggggtttcgcacttgttgcccaggctggagtgcaatggtacaatctcggctcactgcaacctccgcctcccaggttcaagtgattcttctgcctcagcctctcaagtaactgggattacaggcatgcgccactaagggaggagaccactcctcatattgtcttatgcccaatttctgcttccaaagaaagaagaagtaaaaactaaaaggcagaaatgaaatccacaggcagacagcccagcgccacaccatgggcctggtagttaaagatcgagccctgacctaatcggttatgttatctacagattacagacattgtatagaaaagcactttgaaaatccctgtcctgttctgttccattctaattactggtgcatgcagccttcagtcacttactccctgcttgctcaatcgatcacgaccctctcatgcaaacccccttagagttgtaagcccttaagagggataggaattgctcactcagggagctcagtttttgagacgtgagtcttgccaatgctcccggccgaataaagcccttccttcttta

SEQ ID NO: 361336 - DNA, 2316 bp, Homo sapiens
  misc_feature (565)..(565): n is a, c, g, or t
  misc_feature (603)..(603): n is a, c, g, or t
  misc_feature (1087)..(1087): n is a, c, g, or t
  misc_feature (1093)..(1093): n is a, c, g, or t
  misc_feature (1118)..(1118): n is a, c, g, or t
cccattgtctctcgctgacgcgtcggagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagatggagtctcggtctttcacccaggctggagcgctgtggcacgatctcggctcactgcaacctccacctcccaggttcacaccattctcctgcctcagcttcctgagtagctgggactgcaggcacccgccaccatgcccggctaatttttttgtatttttagtagagatggggtttcactgtgttngccgggatggtcaatctcctgaccttgtgatccgcccnccttggccctccaaagtgctgggattacaggcgtgagccaccgcacctggccattatgccactaactttaacctatcccaccttaatcaagggtgtacttaaaagatggtaacaatatactgtttggtacgtagtggaataacatctctacttgtcactttgccagtggctttaaactgcaaatgagttgaattgttcccatagcttaaattttttttcttattgaaatctattactagtatttgtgggtatacagtatgtgtatatctttatgccttatatggcatattttgattcaggcctacaatatgtagtaattacattagggtaaagtatccatcacctctagcatttatcctttgaattacagtgtaattatacatttttaattattttaaaatgtacaattaaattgttactgactacaggtttatttttatggtcataataaaaattatacagaaaaataaataaaatatggccnggtgcngtggctcaggcctgtaatcccagcnctttccaaggcaggtggattgtctgaggtcaggagttcaagaccatcctggccaacatagtgaaaccccgtctgaggaagcgctcctttcgcgggggcactcgctgtggatgaataaagtacactgacacacattctgctctgccagtccagctgagggtccgagccgcttacaggctccaaggccaggcacggtggctcatgcctataattccagcactttggagggccaaggcaggcggatcatctgaggtcaggagttcacgcaaatcagggggcccgtgaaaggcaactgagcagggatccatgggaaagacaccctcagaggcacaagattctctcgttacctttcagtttgctgatacttcagttaaagtctcctgggaaacgtctgcattaggttcttcctctgtagttcttcttaccttgcctgtaaaacaaaacctatctagtgtctgcataggtttccacttcttgtccccacctgaggaatggaaagcaacggcacagtccttgctcatgttttggagtgaaaggagcttgaaggtcatgtgagctttgccaaggcttctcctggcctcatgtcagatacagctcctaactcccaagcagcctaccatagtgtcctcctttttttgcgtgtgtgatggggtttcgcacttgttgcccaggctggagtgcaatggtacaatctcggctcactgcaacctccgcctcccaggttcaagtgattcttctgcctcagcctctcaagtaactgggattacaggcatgcgccactaagggaggagaccactcctcatattgtcttatgcccaatttctgcttccaaagaaagaagaagtaaaaactaaaaggcagaaatgaaatccacaggcagacagcccagcgccacaccatgggcctggtagttaaagatcgagccctgacctaatcggttatgttatctacagattacagacattgtatagaaaagcactttgaaaatccctgtcctgttctgttccattctaattactggtgcatgcagccttcagtcacttactccctgcttgctcaatcgatcacgaccctctcatgcaaacccccttagagttgtaagcccttaagagggataggaattgctcactcagggagctcagtttttgagacgtgagtcttgccaatgctcccggccgaataaagcccttccttcttta

SEQ ID NO: 361337 - DNA, 657 bp, Homo sapiens
cccattgtctctcgctgacgcgtcggagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttgatggagtctcggtctttcacccaggctggagcgctgtggcacgatctcggctcactgcaacctccacctccgagaattgcttgaacctgggaggcggaggttgctgttagccgggaccgcgccgctgcactccagcttgggtgacagagtgagactccatctcaaacaaaacaaaacaaacacaaatgaaagggaaggaagtggattactgataataactaaggtatggaatcaacctgagtgttcatcagtaggtgaatggagaaagaaaatgtggtatatgtacacaatgaaatgccattcagcccttaaaaataaagtcttgttatttgcaacattcatgaatctgaaaggtatgctaagtaaacccagcac

SEQ ID NO: 361338 - DNA, 282 bp, Homo sapiens
tctgtgttgaaaatcattttattggataattttagtcctataagtcagaaccacttctctttactctctcatttcacctgaagtcaaattaaaaattccacccatggccacttggtaaaaataagtgtgtgtgtttttttcagggaccattgcaatttagagatgtggccatagaattctctctggaggagtggcattgcctggacgctgcacagcggaatctatatagggatgtgatgttagagaactacagaaacctgatcttccttggtgaggataact

SEQ ID NO: 361339 - DNA, 480 bp, Homo sapiens
ctgtgttgaaaatcattttattggataattttagtcctataagtcagaaccacttctctttactctctcatttcacctgaagtcaaattaaaaattccacccatggccacttggtaaaaataagtgtgtgtgtttttttcagggaccattgcaatttagagatgtggccatagaattctctctggaggagtggcattgcctggacgctgcacagcggaatctatatagggatgtgatgttagagaactacagaaacctgatcttccttggtgaggataacttgagtacataattcataatattactctaaaggttttatttctcttttttgtagaatgttttttagtaatttattctttgcatacaagagtttcagatctcctttttccagaaaaatcttcagaattttttcatttagaaaagaatttcttcatgatgtttcatcttaatccaaactttccacattcctgagttgagctg

SEQ ID NO: 361340 - DNA, 1293 bp, Homo sapiens
cccattgtctctcgctgacgcgtcggagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagatggagttaaattcacccgcctcggcctcccaaagtgctggggtaacaggcatgagccaccgcacccagccaagtttatttcaacaagtgcatgctcaagagtgtattgtatcatttctatatatttgaaaatttatcaattatttatattattgtcttatactctaattccatttttgtcatagaaagtaatctatgaaattttagtttaaaaaaatgtgttaagactttgtttttgacctaacaggtggtctatgaagaggaatgttttatgagctattgagaaggctatgtatcctgatgatgttgaggagtgttctctataccttcattagaaataattgttttttactgccttctagtcctctgttcccttactaatatactgtcttgttttattattattacagaaagtggggtattgaaatatcctactataattatattgctctattcaactttgttagtatttgctttatatatttgaaaccccaatttgagacacacacacgcacaaatacacacatggatcaacaaatttgtcataggtttccatgaattaatctatatattgtttaatgtccttcttttttgaagttttaacttaaagtacattttataaaatatgacagcttttgactttaacaatgtagcttgtgtaatattattttgacctcttctgctctcattttgttagtatttacatgaaatttctacttggtcttgccactttcagtcttttcttatcattagatctcagctgactcttgtaaaaaggcaagttgagtcttgatttttaaaattttttaatgagcctttttagaagtatgtctcttgattggaaagataattatatttaaatagttttctgaaagagaaaaacttactgttaataaaataattgttttgattctt

SEQ ID NO: 361341 - DNA, 5074 bp, Homo sapiens
  misc_feature (1679)..(1679): n is a, c, g, or t
  misc_feature (3741)..(3741): n is a, c, g, or t
  misc_feature (3779)..(3779): n is a, c, g, or t
  misc_feature (4263)..(4263): n is a, c, g, or t
  misc_feature (4269)..(4269): n is a, c, g, or t
  misc_feature (4294)..(4294): n is a, c, g, or t
cccattgtctctcgctgacgcgtcggagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagttatgtattctcattttgcccaagacctttggtcagagcagagcataaaagattctttccaaaaagtgatactaagaagatatgaaaaatgtagacatgacaatttacagttaaaaaaaggctgtgaaagtgtagatgagtgtccagtgcacaaaagaggttataatggacttaaacaatgtttggcaactacccagagaaaaatatttcaatgtgatgaatatgtgaaattcttgcataaattttcaaattcaaacaaacataagataagagatactggaaaaaaatcttttaaatgtatagaatatgggaaaacttttaaccagtcttcaacccgtactacatataagaaaattgatgctggagagaaacgctataaatgtgaagaatgtggtaaagcctataagcagtcctcacaccttactacacataagaaaattcatactggagagaaaccctacaaatgtgaagaatgtggcaaagcctataagcagtcctgtaaccttactacacataagataattcatactggagagaaaccctacagatgtagagaatgtggcaaagcttttaaccaccctgcaacccttttttcacataagaaaattcatactggagagaaaccatacaagtgtgataaatgtggcaaagcctttatttcatcctcaacccttactaaacatgagataattcatactggagagaaaccctacaaatgtgaggaatgtggcaaagcttttaaccgttcctcaaaccttactaaacataagagaattcatactggagatgtaccctacaaatgtgacgaatgtggcaaaacctttacctggtactcaagcctctctaaacataagagagctcatactggagagaaaccctacaagtgtgaagaatgtggcaaagcctttactgcattctcaactctaactgaacataagataattcatactggagagaaaccgtacaaatgtgaagaatgtggcaaagcttttaactggtcctcagcccttaataaacataagaaaattcatattagacagaaaccctgcatagtgaagaatgtggaaaatcttttaaatgttcctcaacccttaataagcataagataattcatactggagagaaaccgtatgaatgtgatgaatgtgggaaagcctttaactagccctggactctgactaaatatgagaatttatatggaacataaaccctacaaatataaagaatgtgacaaagctttttaaggaagttctcaacccttattacacataatttatactggacagaaaccctacaagtgngaagaatatggcaaagcctataacaacctgtcaactctttttgttttttgagatggagtttcactcttgtcacccaggctggagtgcaatggcacgatctcagctcactgcaacttctgcctcctggtatcaagccattctcctgcctcagcctcccgagtagctgggattactggtgcccaccaccatgcccagctaatttttgtatttttagtagagatggggtttcatcatgtttgccagactggtctccaactcctgacctcagatggtccacccacctcggcatcctaaagtgctgagatgacaggcatgagccacgacgcccagccacaagttctcaattcttaagagacatggcgataattcatgctgaagaggaactctacaaacctgaaagatgcaacagtgcttttaccaccacctccaacttttgtatacataaaaataaattatactaatgtgaaaccctggaaatgtatgaaatgagacaaagcgtttatatggttgccacacttgattgtaggtaagagaattaatgctgccaaaactcctacaagtgtgaagaatgtggcaaaacttttgagtgcttacaccttatttcacaggaaagcttttatccttgagaaaaatcgtacagatataaagaatatggaaacgccattaacgcccactcacatctcaacagaaggttcatagttaataaaagcaataaaagtgcaattactgtcaaaaaatctttcagaaaatataagcctttaaagaagaatatttattctgaaatcagctattacaaatataagggggggttgtagtacctttacttgtatcacagatcttgttgcacacattgtgtactagaggaaaacctgaagcagttgctccagctttattcaacaacatggaatttatattggagaagagtcctgcaaatataatgaatttggaaagactttttttttcaaaatctatagcttagaaaacatcagagagtttatactaaagtatatttttgcagatgtaaatatgaaaaaaatatttaattcaaaattgattttacgtaaatatgagaatttacactagaataaggcactgacacttcagacattacactaaatcagagtattgagtataaaaatgaatccacaactaaagctgtttttgtatataactttaaaagggagattttctgaagcattgtaatttcattgaaagtgtacttgtttcttgaaaaaaatttttgaacagtgaataatgatgtaatacaactttcaaatttctttacgctgttattttattcctattgtggtcacatgtgaaagcatgtgatcaattgttgctgcatcagggatattacagattcttttttattgggtattatgaccttttctataaaagaataaggacattaaaatgtaagatgcatgataaaaatgtaagtggagaggctctttgtagttaacttatattaagtaatgtataaggtgggggttctcatttgtataatcctagcctatgacttaatgttgatgttttgctttgtcttttggatggcctaacctacattaacatgttggcagaccattttaaaacttttttttttcaaaaattataatgaattactttattaataaagatttttaaaaagtgggggttcagagtaatagttttctacattatagtgagaaaaattacagttaaaagtattaaatgagaatattattttactaattgtacttttatgtaatcgaatgcagtatatttaaaaattgttagatgatgtgtgaacttaatttcattttttataccatgttaagactattctgcgtttaatgaagcattattatgccactaactttttttctttttttttgaatggagtctcggtctttcacccaggctggagcgctgtggcacgatctcggctcactgcaacctccacctcccaggttcacaccattctcctgcctcagcttcctgagtagctgggactgcaggcacccgccaccatgcccggctaatttttttgtatttttagtagagatggggtttcactgtgttngccgggatggtcaatctcctgaccttgtgatccgcccnccttggccctccaaagtgctgggattacaggcgtgagccaccgcacctggccattatgccactaactttaacctatcccaccttaatcaagggtgtacttaaaagatggtaacaatatactgtttggtacgtagtggaataacatctctacttgtcactttgccagtggctttaaactgcaaatgagttgaattgttcccatagcttaaattttttttcttattgaaatctattactagtatttgtgggtatacagtatgtgtatatctttatgccttatatggcatattttgattcaggcctacaatatgtagtaattacattagggtaaagtatccatcacctctagcatttatcctttgaattacagtgtaattatacatttttaattattttaaaatgtacaattaaattgttactgactacaggtttatttttatggtcataataaaaattatacagaaaaataaataaaatatggccnggtgcngtggctcaggcctgtaatcccagcnctttccaaggcaggtggattgtctgaggtcaggagttcaagaccatcctggccaacatagtgaaaccccgtctgaggaagcgctcctttcgcgggggcactcgctgtggatgaataaagtacactgacacacattctgctctgccagtccagctgagggtccgagccgcttacaggctccaaggccaggcacggtggctcatgcctataattccagcactttggagggccaaggcaggcggatcatctgaggtcaggagttcacgcaaatcagggggcccgtgaaaggcaactgagcagggatccatgggaaagacaccctcagaggcacaagattctctcgttacctttcagtttgctgatacttcagttaaagtctcctgggaaacgtctgcattaggttcttcctctgtagttcttcttaccttgcctgtaaaacaaaacctatctagtgtctgcataggtttccacttcttgtccccacctgaggaatggaaagcaacggcacagtccttgctcatgttttggagtgaaaggagcttgaaggtcatgtgagctttgccaaggcttctcctggcctcatgtcagatacagctcctaactcccaagcagcctaccatagtgtcctcctttttttgcgtgtgtgatggggtttcgcacttgttgcccaggctggacgctccaactcggcacaaggtcgcctcactcgtcgatggtacgcctcccagcgttaaagtgatgtaagatcacgtaatgaataaaaagaactgggattaaagca

SEQ ID NO: 361342 - DNA, 3209 bp, Homo sapiens
  misc_feature (1679)..(1679): n is a, c, g, or t
cccattgtctctcgctgacgcgtcggagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagttatgtattctcattttgcccaagacctttggtcagagcagagcataaaagattctttccaaaaagtgatactaagaagatatgaaaaatgtagacatgacaatttacagttaaaaaaaggctgtgaaagtgtagatgagtgtccagtgcacaaaagaggttataatggacttaaacaatgtttggcaactacccagagaaaaatatttcaatgtgatgaatatgtgaaattcttgcataaattttcaaattcaaacaaacataagataagagatactggaaaaaaatcttttaaatgtatagaatatgggaaaacttttaaccagtcttcaacccgtactacatataagaaaattgatgctggagagaaacgctataaatgtgaagaatgtggtaaagcctataagcagtcctcacaccttactacacataagaaaattcatactggagagaaaccctacaaatgtgaagaatgtggcaaagcctataagcagtcctgtaaccttactacacataagataattcatactggagagaaaccctacagatgtagagaatgtggcaaagcttttaaccaccctgcaacccttttttcacataagaaaattcatactggagagaaaccatacaagtgtgataaatgtggcaaagcctttatttcatcctcaacccttactaaacatgagataattcatactggagagaaaccctacaaatgtgaggaatgtggcaaagcttttaaccgttcctcaaaccttactaaacataagagaattcatactggagatgtaccctacaaatgtgacgaatgtggcaaaacctttacctggtactcaagcctctctaaacataagagagctcatactggagagaaaccctacaagtgtgaagaatgtggcaaagcctttactgcattctcaactctaactgaacataagataattcatactggagagaaaccgtacaaatgtgaagaatgtggcaaagcttttaactggtcctcagcccttaataaacataagaaaattcatattagacagaaaccctgcatagtgaagaatgtggaaaatcttttaaatgttcctcaacccttaataagcataagataattcatactggagagaaaccgtatgaatgtgatgaatgtgggaaagcctttaactagccctggactctgactaaatatgagaatttatatggaacataaaccctacaaatataaagaatgtgacaaagctttttaaggaagttctcaacccttattacacataatttatactggacagaaaccctacaagtgngaagaatatggcaaagcctataacaacctgtcaactctttttgttttttgagatggagtttcactcttgtcacccaggctggagtgcaatggcacgatctcagctcactgcaacttctgcctcctggtatcaagccattctcctgcctcagcctcccgagtagctgggattactggtgcccaccaccatgcccagctaatttttgtatttttagtagagatggggtttcatcatgtttgccagactggtctccaactcctgacctcagatggtccacccacctcggcatcctaaagtgctgagatgacaggcatgagccacgacgcccagccacaagttctcaattcttaagagacatggcgataattcatgctgaagaggaactctacaaacctgaaagatgcaacagtgcttttaccaccacctccaacttttgtatacataaaaataaattatactaatgtgaaaccctggaaatgtatgaaatgagacaaagcgtttatatggttgccacacttgattgtaggtaagagaattaatgctgccaaaactcctacaagtgtgaagaatgtggcaaaacttttgagtgcttacaccttatttcacaggaaagcttttatccttgagaaaaatcgtacagatataaagaatatggaaacgccattaacgcccactcacatctcaacagaaggttcatagttaataaaagcaataaaagtgcaattactgtcaaaaaatctttcagaaaatataagcctttaaagaagaatatttattctgaaatcagctattacaaatataagggggggttgtagtacctttacttgtatcacagatcttgttgcacacattgtgtactagaggaaaacctgaagcagttgctccagctttattcaacaacatggaatttatattggagaagagtcctgcaaatataatgaatttggaaagactttttttttcaaaatctatagcttagaaaacatcagagagtttatactaaagtatatttttgcagatgtaaatatgaaaaaaatatttaattcaaaattgattttacgtaaatatgagaatttacactagaataaggcactgacacttcagacattacactaaatcagagtattgagtataaaaatgaatccacaactaaagctgtttttgtatataactttaaaagggagattttctgaagcattgtaatttcattgaaagtgtacttgtttcttgaaaaaaatttttgaacagtgaataatgatgtaatacaactttcaaatttctttacgctgttattttattcctattgtggtcacatgtgaaagcatgtgatcaattgttttaacttatattaagtaatgtataaggtgggggttctcatttgtataatcctagcctatgacttaatgttgatgttttgctttgtcttttggatggcctaacctacattaacatgttggcagaccattttaaaacttttttttttcaaaaattataatgaattactttattaataaagatttttaaaaagtg

SEQ ID NO: 361343 - DNA, 3987 bp, Homo sapiens
  misc_feature (1679)..(1679): n is a, c, g, or t
cccattgtctctcgctgacgcgtcggagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagttatgtattctcattttgcccaagacctttggtcagagcagagcataaaagattctttccaaaaagtgatactaagaagatatgaaaaatgtagacatgacaatttacagttaaaaaaaggctgtgaaagtgtagatgagtgtccagtgcacaaaagaggttataatggacttaaacaatgtttggcaactacccagagaaaaatatttcaatgtgatgaatatgtgaaattcttgcataaattttcaaattcaaacaaacataagataagagatactggaaaaaaatcttttaaatgtatagaatatgggaaaacttttaaccagtcttcaacccgtactacatataagaaaattgatgctggagagaaacgctataaatgtgaagaatgtggtaaagcctataagcagtcctcacaccttactacacataagaaaattcatactggagagaaaccctacaaatgtgaagaatgtggcaaagcctataagcagtcctgtaaccttactacacataagataattcatactggagagaaaccctacagatgtagagaatgtggcaaagcttttaaccaccctgcaacccttttttcacataagaaaattcatactggagagaaaccatacaagtgtgataaatgtggcaaagcctttatttcatcctcaacccttactaaacatgagataattcatactggagagaaaccctacaaatgtgaggaatgtggcaaagcttttaaccgttcctcaaaccttactaaacataagagaattcatactggagatgtaccctacaaatgtgacgaatgtggcaaaacctttacctggtactcaagcctctctaaacataagagagctcatactggagagaaaccctacaagtgtgaagaatgtggcaaagcctttactgcattctcaactctaactgaacataagataattcatactggagagaaaccgtacaaatgtgaagaatgtggcaaagcttttaactggtcctcagcccttaataaacataagaaaattcatattagacagaaaccctgcatagtgaagaatgtggaaaatcttttaaatgttcctcaacccttaataagcataagataattcatactggagagaaaccgtatgaatgtgatgaatgtgggaaagcctttaactagccctggactctgactaaatatgagaatttatatggaacataaaccctacaaatataaagaatgtgacaaagctttttaaggaagttctcaacccttattacacataatttatactggacagaaaccctacaagtgngaagaatatggcaaagcctataacaacctgtcaactctttttgttttttgagatggagtttcactcttgtcacccaggctggagtgcaatggcacgatctcagctcactgcaacttctgcctcctggtatcaagccattctcctgcctcagcctcccgagtagctgggattactggtgcccaccaccatgcccagctaatttttgtatttttagtagagatggggtttcatcatgtttgccagactggtctccaactcctgacctcagatggtccacccacctcggcatcctaaagtgctgagatgacaggcatgagccacgacgcccagccacaagttctcaattcttaagagacatggcgataattcatgctgaagaggaactctacaaacctgaaagatgcaacagtgcttttaccaccacctccaacttttgtatacataaaaataaattatactaatgtgaaaccctggaaatgtatgaaatgagacaaagcgtttatatggttgccacacttgattgtaggtaagagaattaatgctgccaaaactcctacaagtgtgaagaatgtggcaaaacttttgagtgcttacaccttatttcacaggaaagcttttatccttgagaaaaatcgtacagatataaagaatatggaaacgccattaacgcccactcacatctcaacagaaggttcatagttaataaaagcaataaaagtgcaattactgtcaaaaaatctttcagaaaatataagcctttaaagaagaatatttattctgaaatcagctattacaaatataagggggggttgtagtacctttacttgtatcacagatcttgttgcacacattgtgtactagaggaaaacctgaagcagttgctccagctttattcaacaacatggaatttatattggagaagagtcctgcaaatataatgaatttggaaagactttttttttcaaaatctatagcttagaaaacatcagagagtttatactaaagtatatttttgcagatgtaaatatgaaaaaaatatttaattcaaaattgattttacgtaaatatgagaatttacactagaataaggcactgacacttcagacattacactaaatcagagtattgagtataaaaatgaatccacaactaaagctgtttttgtatataactttaaaagggagattttctgaagcattgtaatttcattgaaagtgtacttgtttcttgaaaaaaatttttgaacagtgaataatgatgtaatacaactttcaaatttctttacgctgttattttattcctattgtggtcacatgtgaaagcatgtgatcaattgttgctgcatcagggatattacagattcttttttattgggtattatgaccttttctataaaagaataaggacattaaaatgtaagatgcatgataaaaatgtaagtggagaggctctttgtagttaacttatattaagtaatgtataaggtgggggttctcatttgtataatcctagcctatgacttaatgttgatgttttgctttgtcttttggatggcctaacctacattaacatgttggcagaccattttaaaacttttttttttcaaaaattataatgaattactttattaataaagatttttaaaaagtgggggttcagagtaatagttttctacattatagtgagaaaaattacagttaaaagtattaaatgagaatattattttactaattgtacttttatgtaatcgaatgcagtatatttaaaaattgttagatgatgtgtgaacttaatttcattttttataccatgttaagactattctgcgtttaatgaagcattattatgccactaactttttttctttttttttgaatggagtctcggtctttcacccaggctggagcgctgtggcacgatctcggctcactgcaacctccacctcctctgggcaacagagcaagactctatttcaaaaaaaaacaaagaaatagaaatagaatccatgtatttctgaatcctgaaaaattattagtaaatgtttattatatagttttctttgaacatctggtctgtctgcaaacatatagaccttttttttttttttttttgagatggagtcttgctctgtccccaggctggagtgcagtggcgtgatctcagctcccgggatcgagtggttctcctacctcagcctcccgaatagctgggactacaggcatgtgccaccatgcttagctaatttttgtatttttagtagggatgggctgtcaccatgttggcaaggatggtctcgatctcttgacct

SEQ ID NO: 361344 - DNA, 742 bp, Homo sapiens
ggtttcaccacgttggccaggctggtctcgaactcctgacctcaggtgatccacctgtcttggcctcctaaagtgttgggattacaggcatgagccaccacgctcggcccagtccagactttttaactacctggccccactgcagacacagttccctctagtccttcccagagttacaagaagagaactccagtagccttattctgtcagggacgaattgtttaccccatgataatgtaggatatcataaattcttcttcaaaggttttagcctgtaatttgttaagtacattgagttctgagatcctctccaaagaaccaatgtatcagtatgttcagctcacctgttctttgttcttcattttaacttttaatttcctcattctttatgtctccttgcccctagtttcagtaaacaatcccctcctagcctctgtcacctgctctgacctgagtcacctttagtcacctggtccgtaaccatctttcctgtctaaacttctcaccccaccactctggcttatacccctgctctctttaaaatagccagtcagaattagcttagattgtgcggtccaaccctagcccataggggaacaacacagcagtagggggtacctgcatcagggataagaacccattcccctcccttgttccggtgtgctctcgccattgcaccatccatgagacgcactcttgtatagaagtaaaattgccttgctgagaaaatgtaaaaaaaaaa

SEQ ID NO: 361345 - DNA, 3825 bp, Homo sapiens
agaccacgggttgcagccggagcggctgggaggatgggcctctccgctgcggccccgttgtggggtcccccggggctgctcctggccatcgccctgcacccagcgctgtcggtgcccccgcgccgggactactgcgtgctgggcgctgggcccgcgggcctgcagatggcctacttcctgcagcgcgctggacgcgactacgcagtgttcgagcgggccccgcggcccggcagcttcttcacacgctacccgcggcaccgcaagctcatcagcatcaacaagcggtacacgggcaaggctaacgccgagttcaacctccgccacgactggaactctctgctcagccacgacccccggctgctcttcagacactactcgcgtgcctacttccccgacgcccgcgacatggtgcgctacctgggtgacttcgcggacacgctggggctccgtgtccagtacaacaccaccatcgcccacgtcactctggacaaggaccgacaggcctggaatggccactacttcatcctaactgaccagaagggccaggtgcatcagtgcagcgtcctccttgtagccactggtttatcagtccccaaccaggttgacttccctggctccgaatatgcagagggttacgagtccgtgtccgtggaccctgaggactttgtaggccagaatgtgctgatcctgggtcgtgggaactcggcctttgagacagcagagaacatcttgggtgtcacaaactttatccatatgctcagccgctcccgggtccgtctgtcctgggccacccactacgttggagacctcagagccatcaacaatggcctgctggatacctaccagctcaagtccctggacgggctgctcgagtctgacctgacggatctggccatcctgaaggacagcaaaggcaagttccatgtcaccccgaaattcttcctggaagaagccagcaccaaccagagtgccgactccatcaccctcccccaggacgacaatgacaactttgccatgcgcgtgccctatgaccgggtaatccgctgcctgggctggaactttgacttctccattttcaataagtccctcagacttaactcgggaaatgcattcggcaagaagtacccgctgattcgagctagctacgaatccaaaggaagccggggtctgtttatcctgggtactgccagccactcggtggactaccggaaatctgctgggggcttcatccacggattccgatacacagtgcgtgctgttcaccggctcctggagcaccgccaccacagcgtcacctggcccgccactgagctccccatcacacagctgaccagctccatcgtgcggcgcgtgaatgaggcttctgggctctaccagatgttcggtgtgctggccgatgtcatcctgttgaaggagaattccacggcctttgagtacctggaggagttccccatacagatgctggcccagctggagacactcacagggaggaaggcaaagcacgggctcttcgtcatcaacatggaatatggcagaaatttctctggccccgacaaggacgtcttctttgatgaccggtctgtggggcacacagaagatgcctggcagtctaactttcttcatcctgtcatctactactatagatacctccccaccgaacaggaggtgaggttccgccctgcacactggcccctgcctcggcccacggccatccatcacatcgtggaagacttcttaacagactggactgccccgatcgggcacatcctacctctgaggcgcttcctggagaactgtttggacaccgatttgcgaagcttctatgcagagtcctgcttcctgttcgccctcacgcgccagaagttgccacccttttgccagcaggggtacctgaggatgcagggactcgtgagtaccgagagcctttggcagcacagagtggagagcaggctcctgcgggactatgcccccacaggcaggcgcctggaggacagcagccagcagcttggcgaccaagagccactaggttcccccctggctccagggcctctggctcagtccgtcgatagcaacaaagaggagctctgactgtcccttcctaagctgtgggcacagtggccaggcctccccacctaggcccatggtcagtccctctttccccgcaacctcacactcccgccaatgcgtgattgccaaagaccactcagatcatggcagtgtctgcagcaaagccaccagatggcacgtgagggctgaaagtcggggatgcggtggtctcctccctcctgtcagggggcagaagggcatcctctgccaggtgggagctgccttccccagcccagtttgtctgcaatggagctgtcgctgagccccaggccagcccagttctgccccgtctcaagtgctcctcttccttccaagcccctcctcagatgggcctgcatcccgcctgtggagtgcttcacaggggaaacccatccgcatcttaagagtttgtggcaagcgctttaaaacaaaagctctgatatcctcaacaaccacaacgggcaggtgggattgttgccccagatgactgctgaagacaccagctgtgggatgtcaagtaattccagggacccccagctgggagtccccgtctgtgtcacttgccacacactgcctcaacctccccgccccattttcagcagggtttgggcttagctacagagcccaagagggtcagccctgcttatcatcataggcccagcaggctgatctcgagcagcgataggacagctccctgcaaagccatcttagcaactttctcactgagaagcaggattcagagctgctctccccagttgcaccccctgactcatcttccagctggctcttctctcccatcctactcccttctgtctccctgccctctgccatcctgaaccatgccttgcttctaacctgcctggtcaagttttgtgaaacttatcctgctgtctcgggctggcacccatatgtgctcaccatgtgtaaggtgacatttccaaatgcctttgtgtgataatgatgatgaatttggttcctagtctcttcttcattgcccttcctcaccagcaatctgcactttcccatcaggcgtcttagtctcatttgtaagtgcataagataatcacagtgatttttcaaagcccaggatcataagtgattgctttttcactggttcttactaactcttcatgtatccactcagaattccaaggacaatcccggcactctgggaggcccaggcaggtggatcgcctgaggtcaggagtttgagaccagcctgaccaacgtggagaaaccctatctctgctgaaggtacaaaactagccaggcgtggtagcacatgtctataatcccagctactggagaggctgaggcaggagaatcacttaaacccgggaggcagaggttgcagtgagccgagattgcgccattgcactccagcctaggtaacaagagggaaactccatctcaaaaaataagttaattaaattaaattaaaataaaacatgcgctgggtacagttgcttacacctgtaatcccagcactttgggaggccaaagtgggccgatcacctgagctcaggaattcgagaccagcctggccaacatagcaaaaccttgtctctactaacggtaaaaaaaattagctgggcatggtggagcatgcctgtcatcccagctacttgggaagctgaggcaggagaattgcttgaacctgggaggtggaggttgcagtgagcagagaccgagccactgtactccagcctaggtgacaaagcaagacccacagtaaagccc

SEQ ID NO: 361346 - DNA, 667 bp, Homo sapiens
gcatgggaaaatccttgcaccaaggctgagctccgtgtggacttgacaagcacagactatgacactgcagacacagttccctctagtccttcccagagttacaagaagagaactccagtagccttattctgtcagggacgaattgtttaccccatgataatgtaggatatcataaattcttcttcaaaggttttagcctgtaatttgttaagtacattgagttctgagatcctctccaaagaaccaatgtatcagtatgttcagctcacctgttctttgttcttcattttaacttttaatttcctcattctttatgtctccttgcccctagtttcagtaaacaatcccctcctagcctctgtcacctgctctgacctgagtcacctttagtcacctggtccgtaaccatctttcctgtctaaacttctcaccccaccactctggcttatacccctgctctctttaaaatagccagtcagaattagcttagattgtgcggtccaaccctagcccataggggaacaacacagcagtagggggtacctgcatcagggataagaacccattcccctcccttgttccggtgtgctctcgccattgcaccatccatgagacgcactcttgtatagaagtaaaattgccttgctgagaaaatgtaaaaaaaaaa

SEQ ID NO: 361347 - DNA, 3926 bp, Homo sapiens
agaccacgggttgcagccggagcggctgggaggatgggcctctccgctgcggccccgttgtggggtcccccggggctgctcctggccatcgccctgcacccagcgctgtcggtgcccccgcgccgggactactgcgtgctgggcgctgggcccgcgggcctgcagatggcctacttcctgcagcgcgctggacgcgactacgcagtgttcgagcgggccccgcggcccggcagcttcttcacacgctacccgcggcaccgcaagctcatcagcatcaacaagcggtacacgggcaaggctaacgccgagttcaacctccgccacgactggaactctctgctcagccacgacccccggctgctcttcagacactactcgcgtgcctacttccccgacgcccgcgacatggtgcgctacctgggtgacttcgcggacacgctggggctccgtgtccagtacaacaccaccatcgcccacgtcactctggacaaggaccgacaggcctggaatggccactacttcatcctaactgaccagaagggccaggtgcatcagtgcagcgtcctccttgtagccactggtttatcagtccccaaccaggttgacttccctggctccgaatatgcagagggttacgagtccgtgtccgtggaccctgaggactttgtaggccagaatgtgctgatcctgggtcgtgggaactcggcctttgagacagcagagaacatcttgggtgtcacaaactttatccatatgctcagccgctcccgggtccgtctgtcctgggccacccactacgttggagacctcagagccatcaacaatggcctgctggatacctaccagctcaagtccctggacgggctgctcgagtctgacctgacggatctggccatcctgaaggacagcaaaggcaagttccatgtcaccccgaaattcttcctggaagaagccagcaccaaccagagtgccgactccatcaccctcccccaggacgacaatgacaactttgccatgcgcgtgccctatgaccgggtaatccgctgcctgggctggaactttgacttctccattttcaataagtccctcagacttaactcgggaaatgcattcggcaagaagtacccgctgattcgagctagctacgaatccaaaggaagccggggtctgtttatcctgggtactgccagccactcggtggactaccggaaatctgctgggggcttcatccacggattccgatacacagtgcgtgctgttcaccggctcctggagcaccgccaccacagcgtcacctggcccgccactgagctccccatcacacagctgaccagctccatcgtgcggcgcgtgaatgaggcttctgggctctaccagatgttcggtgtgctggccgatgtcatcctgttgaaggagaattccacggcctttgagtacctggaggagttccccatacagatgctggcccagctggagacactcacagggaggaaggcaaagcacgggctcttcgtcatcaacatggaatatggcagaaatttctctggccccgacaaggacgtcttctttgatgaccggtctgtggggcacacagaagatgcctggcagtctaactttcttcatcctgtcatctactactatagatacctccccaccgaacaggaggtgaggttccgccctgcacactggcccctgcctcggcccacggccatccatcacatcgtggaagacttcttaacagactggactgccccgatcgggcacatcctacctctgaggcgcttcctggagaactgtttggacaccgatttgcgaagcttctatgcagagtcctgcttcctgttcgccctcacgcgccagaagttgccacccttttgccagcaggggtacctgaggatgcagggactcgtgagtaccgagagcctttggcagcacagagtggagagcaggctcctgcgggactatgcccccacaggcaggcgcctggaggacagcagccagcagcttggcgaccaagagccactaggttcccccctggctccagggcctctggctcagtccgtcgatagcaacaaagaggagctctgactgtcccttcctaagctgtgggcacagtggccaggcctccccacctaggcccatggtcagtccctctttccccgcaacctcacactcccgccaatgcgtgattgccaaagaccactcagatcatggcagtgtctgcagcaaagccaccagatggcacgtgagggctgaaagtcggggatgcggtggtctcctccctcctgtcagggggcagaagggcatcctctgccaggtgggagctgccttccccagcccagtttgtctgcaatggagctgtcgctgagccccaggccagcccagttctgccccgtctcaagtgctcctcttccttccaagcccctcctcagatgggcctgcatcccgcctgtggagtgcttcacaggggaaacccatccgcatcttaagagtttgtggcaagcgctttaaaacaaaagctctgatatcctcaacaaccacaacgggcaggtgggattgttgccccagatgactgctgaagacaccagctgtgggatgtcaagtaattccagggacccccagctgggagtccccgtctgtgtcacttgccacacactgcctcaacctccccgccccattttcagcagggtttgggcttagctacagagcccaagagggtcagccctgcttatcatcataggcccagcaggctgatctcgagcagcgataggacagctccctgcaaagccatcttagcaactttctcactgagaagcaggattcagagctgctctccccagttgcaccccctgactcatcttccagctggctcttctctcccatcctactcccttctgtctccctgccctctgccatcctgaaccatgccttgcttctaacctgcctggtcaagttttgtgaaacttatcctgctgtctcgggctggcacccatatgtgctcaccatgtgtaaggtgacatttccaaatgcctttgtgtgataatgatgatgaatttggttcctagtctcttcttcattgcccttcctcaccagcaatctgcactttcccatcaggcgtcttagtctcatttgtaagtgcataagataatcacagtgatttttcaaagcccaggatcataagtgattgctttttcactggttcttactaactcttcatgtatccactcaggtgatccacctgtcttggcctcctaaagtgttgggattacaggcatgagccaccacgctcggcccagtccagactttttaactacctggccccactgcagacacagttccctctagtccttcccagagttacaagaagagaactccagtagccttattctgtcagggacgaattgtttaccccatgataatgtaggatatcataaattcttcttcaaaggttttagcctgtaatttgttaagtacattgagttctgagatcctctccaaagaaccaatgtatcagtatgttcagctcacctgttctttgttcttcattttaacttttaatttcctcattctttatgtctccttgcccctagtttcagtaaacaatcccctcctagcctctgtcacctgctctgacctgagtcacctttagtcacctggtccgtaaccatctttcctgtctaaacttctcaccccaccactctggcttatacccctgctctctttaaaatagccagtcagaattagcttagattgtgcggtccaaccctagcccataggggaacaacacagcagtagggggtacctgcatcagggataagaacccattcccctcccttgttccggtgtgctctcgccattgcaccatccatgagacgcactcttgtatagaagtaaaattgccttgctgagaaaatgtaaaaaaaaaa

SEQ ID NO: 361348 - DNA, 2470 bp, Homo sapiens
gtgcagcgtgccgttcctccctctggctgttccagtgcgtgctgttcaccggctcctggagcaccgccaccacagcgtcacctggcccgccactgagctccccatcacacagctgaccagctccatcgtgcggcgcgtgaatgaggcttctgggctctaccagatgttcggtgtgctggccgatgtcatcctgttgaaggaaacaggaggtgaggttccgccctgcacactggcccctgcctcggcccacggccatccatcacatcgtggaagacttcttaacagactggactgccccgatcgggcacatcctacctctgaggcgcttcctggagaactgtttggacaccgatttgcgaagcttctatgcagagtcctgcttcctgttcgccctcacgcgccagaagttgccacccttttgccagcaggggtacctgaggatgcagggactcgtgagtaccgagagcctttggcagcacagagtggagagcaggctcctgcgggactatgcccccacaggcaggcgcctggaggacagcagccagcagcttggcgaccaagagccactaggttcccccctggctccagggcctctggctcagtccgtcgatagcaacaaagaggagctctgactgtcccttcctaagctgtgggcacagtggccaggcctccccacctaggcccatggtcagtccctctttccccgcaacctcacactcccgccaatgcgtgattgccaaagaccactcagatcatggcagtgtctgcagcaaagccaccagatggcacgtgagggctgaaagtcggggatgcggtggtctcctccctcctgtcagggggcagaagggcatcctctgccaggtgggagctgccttccccagcccagtttgtctgcaatggagctgtcgctgagccccaggccagcccagttctgccccgtctcaagtgctcctcttccttccaagcccctcctcagatgggcctgcatcccgcctgtggagtgcttcacaggggaaacccatccgcatcttaagagtttgtggcaagcgctttaaaacaaaagctctgatatcctcaacaaccacaacgggcaggtgggattgttgccccagatgactgctgaagacaccagctgtgggatgtcaagtaattccagggacccccagctgggagtccccgtctgtgtcacttgccacacactgcctcaacctccccgccccattttcagcagggtttgggcttagctacagagcccaagagggtcagccctgcttatcatcataggcccagcaggctgatctcgagcagcgataggacagctccctgcaaagccatcttagcaactttctcactgagaagcaggattcagagctgctctccccagttgcaccccctgactcatcttccagctggctcttctctcccatcctactcccttctgtctccctgccctctgccatcctgaaccatgccttgcttctaacctgcctggtcaagttttgtgaaacttatcctgctgtctcgggctggcacccatatgtgctcaccatgtgtaaggtgacatttccaaatgcctttgtgtgataatgatgatgaatttggttcctagtctcttcttcattgcccttcctcaccagcaatctgcactttcccatcaggcgtcttagtctcatttgtaagtgcataagataatcacagtgatttttcaaagcccaggatcataagtgattgctttttcactggttcttactaactcttcatgtatccactcaggtgatccacctgtcttggcctcctaaagtgttgggattacaggcatgagccaccacgctcggcccagtccagactttttaactacctggccccactgcagacacagttccctctagtccttcccagagttacaagaagagaactccagtagccttattctgtcagggacgaattgtttaccccatgataatgtaggatatcataaattcttcttcaaaggttttagcctgtaatttgttaagtacattgagttctgagatcctctccaaagaaccaatgtatcagtatgttcagctcacctgttctttgttcttcattttaacttttaatttcctcattctttatgtctccttgcccctagtttcagtaaacaatcccctcctagcctctgtcacctgctctgacctgagtcacctttagtcacctggtccgtaaccatctttcctgtctaaacttctcaccccaccactctggcttatacccctgctctctttaaaatagccagtcagaattagcttagattgtgcggtccaaccctagcccataggggaacaacacagcagtagggggtacctgcatcagggataagaacccattcccctcccttgttccggtgtgctctcgccattgcaccatccatgagacgcactcttgtatagaagtaaaattgccttgctgagaaaatgtaaaaaaaaaa

SEQ ID NO: 361349 - DNA, 2000 bp, Homo sapiens
agaccacgggttgcagccggagcggctgggaggatgggcctctccgctgcggccccgttgtggggtcccccggggctgctcctggccatcgccctgcacccagcgctgtcggtgcccccgcgccgggactactgcgtgctgggcgctgggcccgcgggcctgcagatggcctacttcctgcagcgcgctggacgcgactacgcagtgttcgagcgggccccgcggcccggcagcttcttcacacgctacccgcggcaccgcaagctcatcagcatcaacaagcggtacacgggcaaggctaacgccgagttcaacctccgccacgactggaactctctgctcagccacgacccccggctgctcttcagacactactcgcgtgcctacttccccgacgcccgcgacatggtgcgctacctgggtgacttcgcggacacgctggggctccgtgtccagtacaacaccaccatcgcccacgtcactctggacaaggaccgacaggcctggaatggccactacttcatcctaactgaccagaagggccaggtgcatcagtgcagcgtcctccttgtagccactggtttatcagtccccaaccaggttgacttccctggctccgaatatgcagagggttacgagtccgtgtccgtggaccctgaggactttgtaggccagaatgtgctgatcctgggtcgtgggaactcggcctttgagacagcagagaacatcttgggtgtcacaaactttatccatatgctcagccgctcccgggtccgtctgtcctgggccacccactacgttggagacctcagagccatcaacaatggcctgctggatacctaccagctcaagtccctggacgggctgctcgagtctgacctgacggatctggccatcctgaaggacagcaaaggcaagttccatgtcaccccgaaattcttcctggaagaagccagcaccaaccagagtgccgactccatcaccctcccccaggacgacaatgacaactttgccatgcgcgtgccctatgaccgggtaatccgctgcctgggctggaactttgacttctccattttcaataagtccctcagacttaactcgggaaatgcattcggcaagaagtacccgctgattcgagctagctacgaatccaaaggaagccggggtctgtttatcctgggtactgccagccactcggtggactaccggaaatctgctgggggcttcatccacggattccgatacacagtgcgtgctgttcaccggctcctggagcaccgccaccacagcgtcacctggcccgccactgagctccccatcacacagctgaccagctccatcgtgcggcgcgtgaatgaggcttctgggctctaccagatgttcggtgtgctggccgatgtcatcctgttgaaggagaattccacggcctttgagtacctggaggagttccccatacagatgctggcccagctggagacactcacagggaggaaggcaaagcacgggctcttcgtcatcaacatggaatatggcagaaatttctctggccccgacaaggacgtcttctttgatgaccggtctgtggggcacacagaagatgcctggcagtctaactttcttcatcctgtcatctactactatagatacctccccaccgaacaggaggtgaggttccgccctgcacactggcccctgcctcggcccacggccatccatcacatcgtggaagacttcttaacagactggactgccccgatcgggcacatcctacctctgaggcgcttcctggagaactgtttggacaccgatttgcgaagcttctatgcagagtcctgcttcctgttcgccctcacgcgccagaagttgccacccttttgccagcaggggtacctgaggatgcagggactcatggctcagcgacttcttctgaggaggttcctggcctctgtcatctccaggaagccctctcagggtcagtggccacccctcacttccagagc

SEQ ID NO: 361350 - DNA, 1378 bp, Homo sapiens
actgtgtttatgtttttattttgattcatacttggcttgctgaaaaatacgctgtaaatataaaatactgcagtaatgccgacaatcaacatggtgaaaggtgacagtctttttgatttctgctcaactcattattttatacaataagctcagacgaataatacccaatttggataatgttacgcttgacaaaacactttacttcatttagtcctcacaacaaccctgtgaggtaggcacattctcggaggtaaaatgacgtgggcaaagttccctggctcgtttggggaaaggctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccaggtcggtcatgcaggagcccaccactaccaccgccgccacctcctcttgccactgcctctggggttccccagacgccgccatcgctcaaaggtgctgctgtccaacctggacggtgacctctgccctttgcccgaccccgtaaccagagacgccactcctgccctccctaacgacgcgggcctttcagacgcctacgcgggtcgcccacctgactgcccgaaatcaccccgcccaccaagtgtcccctcttcttcctggaatagtctcggtgcacagcctcacgtaacagggccctcctgatatggcgagactccgcgctcctcgtcactcacggggcaggcgctgaggaaggaactgtcaggcaccgcggggacgcctttccgagcgcccggctcggcgcggcgcgggggcgcgcacgccgcccagcttcggggccgcagagggggcgcgctcgggtacctgtaccccacgtagtcgccggttaccgatcggactaagttccaggtacctggactggggctggtgcggggaggttggatcccgagtcgcacaggtggcgtggagaactgtggtttaaatatggccaggggactcgcctcctcttcctatggagaaggcccccgttccaaagatgcccttctcatccccatcacgctgattccctcaagaacgagcccccaaggccagaggcgtctctttctccatatctggcccatcccctggttcctgtaaaccccgagtattagttccttgttgcctg

SEQ ID NO: 361351 - DNA, 470 bp, Homo sapiens
  misc_feature (1)..(3): n is a, c, g, or t
  misc_feature (38)..(38): n is a, c, g, or t
nnnggccagctaggcaatcgacaatttttgggacaatngtcctgagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 361352 - DNA, 1452 bp, Homo sapiens
actgtgtttatgtttttattttgattcatacttggcttgctgaaaaatacgctgtaaatataaaatactgcagtaatgccgacaatcaacatggtgaaaggtgacagtctttttgatttctgctcaactcattattttatacaataagctcagacgaataatacccaatttggataatgttacgcttgacaaaacactttacttcatttagtcctcacaacaaccctgtgaggtaggcacattctcggaggtaaaatgacgtgggcaaagttccctggctcgtttggggaaaggctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccaggtcggtcatgcaggagcccaccactaccaccgccgccacctcctcttgccactgcctctggggttccccagacgccgccatcgctcaaaggtgctgctgtccaacctggacggtgacctctgccctttgcccgaccccgtaaccagagacgccactcctgccctccctaacgacgcgggcctttcagacgcctacgcgggtcgcccacctgactgcccgaaatcaccccgcccaccaagtgtcccctcttcttcctggaatagtctcggtgcacagcctcacgtaacagggccctcctgatatggcgagactccgcgctcctcgtcactcacggggcaggcgctgaggaaggaactgtcaggcaccgcggggacgcctttccgagcgcccggctcggcgcggcgcgggggcgcgcacgccgcccagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccaggtacctggactggggctggtgcggggaggttggatcccgagtcgcacaggtggcgtggagaactgtggtttaaatatggccaggggactcgcctcctcttcctatggagaaggcccccgttccaaagatgcccttctcatccccatcacgctgattccctcaagaacgagcccccaaggccagaggcgtctctttctccatatctggcccatcccctggttcctgtaaaccccgagtattagttccttgttgcctg

SEQ ID NO: 361353 - DNA, 223 bp, Homo sapiens
gatcatcaagactttatccaaggaggaagagaccaagaaataaaacctccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 361354 - DNA, 2760 bp, Homo sapiens
actgtgtttatgtttttattttgattcatacttggcttgctgaaaaatacgctgtaaatataaaatactgcagtaatgccgacaatcaacatggtgaaaggtgacagtctttttgatttctgctcaactcattattttatacaataagctcagacgaataatacccaatttggataatgttacgcttgacaaaacactttacttcatttagtcctcacaacaaccctgtgaggtaggcacattctcggaggtaaaatgacgtgggcaaagttccctggctcgtttggggaaaggctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccaggtcggtcatgcaggagcccaccactaccaccgccgccacctcctcttgccactgcctctggggttccccagacgccgccatcgctcaaaggtgctgctgtccaacctggacggtgacctctgccctttgcccgaccccgtaaccagagacgccactcctgccctccctaacgacgcgggcctttcagacgcctacgcgggtcgcccacctgactgcccgaaatcaccccgcccaccaagtgtcccctcttcttcctggaatagtctcggtgcacagcctcacgtaacagggccctcctgatatggcgagactccgcgctcctcgtcactcacggggcaggcgctgaggaaggaactgtcaggcaccgcggggacgcctttccgagcgcccggctcggcgcggcgcgggggcgcgcacgccgcccagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 361355 - DNA, 2778 bp, Homo sapiens
  misc_feature (594)..(594): n is a, c, g, or t
cccccttaggtattgattaccccctggcgcccctttccaaggccctgaaccagcttccccagcatctcagcctgcccacccttgaggccaagttaaatctcagcctcacctttcattggcaccagaacacatctgagagggtgtaggaaactggggatccaggtcaagcaattggcaggggcctggattgaacaaggttttcactcccactcctgcgggccaattgttagggcttccaaagaagttgctggagttatttcgagctggcagaccatgactttggctctgctaatgacattggctgctgccctcagatcctccgtattcaaaagtaaatttgctccagccactatgacaatgatattctggccttcattattgacaattatagaagcagttcctgtagcagcatctttagtctgatatgtaaattctgtagaaatatcattctgttttaagttttctatataatcattgccaaaagaatctttgccaaccttacacaccatggacgtcattgctccaagccgagcagcttggacacactggttggcacctttccctccaaagccaataaaaaacttatgtccatgnatggtttctccagtttttggcaaacgagaagtaagagaccaggtcggtcatgcaggagcccaccactaccaccgccgccacctcctcttgccactgcctctggggttccccagacgccgccatcgctcaaaggtgctgctgtccaacctggacggtgacctctgccctttgcccgaccccgtaaccagagacgccactcctgccctccctaacgacgcgggcctttcagacgcctacgcgggtcgcccacctgactgcccgaaatcaccccgcccaccaagtgtcccctcttcttcctggaatagtctcggtgcacagcctcacgtaacagggccctcctgatatggcgagactccgcgctcctcgtcactcacggggcaggcgctgaggaaggaactgtcaggcaccgcggggacgcctttccgagcgcccggctcggcgcggcgcgggggcgcgcacgccgcccagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 361356 - DNA, 2724 bp, Homo sapiens
  misc_feature (540)..(540): n is a, c, g, or t
cccccttaggtattgattaccccctggcgcccctttccaaggccctgaaccagcttccccagcatctcagcctgcccacccttgaggccaagttaaatctcagcctcacctttcattggcaccagaacacatctgagagggtgtaggaaactggggatccaggtcaagcaattggcaggggcctggattgaacaaggttttcactcccactcctgcgggccaattgttagggcttccaaagaagttgctggagttatttcgagctggcagaccatgactttggctctgctaatgacattggctgctgccctcagatcctccgtattcaaaagtaaatttgctccagccactatgacaatgatattctggccttcattattgacaattatagaagcagttcctaagttttctatataatcattgccaaaagaatctttgccaaccttacacaccatggacgtcattgctccaagccgagcagcttggacacactggttggcacctttccctccaaagccaataaaaaacttatgtccatgnatggtttctccagtttttggcaaacgagaagtaagagaccaggtcggtcatgcaggagcccaccactaccaccgccgccacctcctcttgccactgcctctggggttccccagacgccgccatcgctcaaaggtgctgctgtccaacctggacggtgacctctgccctttgcccgaccccgtaaccagagacgccactcctgccctccctaacgacgcgggcctttcagacgcctacgcgggtcgcccacctgactgcccgaaatcaccccgcccaccaagtgtcccctcttcttcctggaatagtctcggtgcacagcctcacgtaacagggccctcctgatatggcgagactccgcgctcctcgtcactcacggggcaggcgctgaggaaggaactgtcaggcaccgcggggacgcctttccgagcgcccggctcggcgcggcgcgggggcgcgcacgccgcccagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 361357 - DNA, 2242 bp, Homo sapiens
actgtgtttatgtttttattttgattcatacttggcttgctgaaaaatacgctgtaaatataaaatactgcagtaatgccgacaatcaacatggtgaaaggtgacagtctttttgatttctgctcaactcattattttatacaataagctcagacgaataatacccaatttggataatgttacgcttgacaaaacactttacttcatttagtcctcacaacaaccctgtgaggtaggcacattctcggaggtaaaatgacgtgggcaaagttccctggctcgtttggggaaaggctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctaagcaagagataaagtaataatgggtactgtggggaaaaacacagaagaacaattcggtaatatagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 361358 - DNA, 1636 bp, Homo sapiens
cggtgacggagactgcccaggtgtggtcaccatgttcctctccgcggtcttctttgccaagagcaagtcaaatggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 361359 - DNA, 3045 bp, Homo sapiens
actgtgtttatgtttttattttgattcatacttggcttgctgaaaaatacgctgtaaatataaaatactgcagtaatgccgacaatcaacatggtgaaaggtgacagtctttttgatttctgctcaactcattattttatacaataagctcagacgaataatacccaatttggataatgttacgcttgacaaaacactttacttcatttagtcctcacaacaaccctgtgaggtaggcacattctcggaggtaaaatgacgtgggcaaagttccctggctcgtttggggaaaggctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccaggtcggtcatgcaggagcccaccactaccaccgccgccacctcctcttgccactgcctctggggttccccagacgccgccatcgctcaaaggtgctgctgtccaacctggacggtgacctctgccctttgcccgaccccgtaaccagagacgccactcctgccctccctaacgacgcgggcctttcagacgcctacgcgggtcgcccacctgactgcccgaaatcaccccgcccaccaagtgtcccctcttcttcctggaatagtctcggtgcacagcctcacgtaacagggccctcctgatatggcgagactccgcgctcctcgtcactcacggggcaggcgctgaggaaggaactgtcaggcaccgcggggacgcctttccgagcgcccggctcggcgcggcgcgggggcgcgcacgccgcccagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaactagtgtcttccctctgtgcgtgcatgtgtgtgtttcatacccaagcatttcctatctggggcagtccttcacggcgagaaggagttacctgagtcaatgtgaccaacctgctgggtttcagccactcatccagcctgacctaaggctgttgctcaataacaaatggcctctagcacacacagccccacccgctgccatccatacccctccagccccctgtgtggacaccttgttcccaggccagccccacacagtaggcagtcattaaagtttggtgagtgcac

SEQ ID NO: 361360 - DNA, 3137 bp, Homo sapiens
actgtgtttatgtttttattttgattcatacttggcttgctgaaaaatacgctgtaaatataaaatactgcagtaatgccgacaatcaacatggtgaaaggtgacagtctttttgatttctgctcaactcattattttatacaataagctcagacgaataatacccaatttggataatgttacgcttgacaaaacactttacttcatttagtcctcacaacaaccctgtgaggtaggcacattctcggaggtaaaatgacgtgggcaaagttccctggctcgtttggggaaaggctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccaggtcggtcatgcaggagcccaccactaccaccgccgccacctcctcttgccactgcctctggggttccccagacgccgccatcgctcaaaggtgctgctgtccaacctggacggtgacctctgccctttgcccgaccccgtaaccagagacgccactcctgccctccctaacgacgcgggcctttcagacgcctacgcgggtcgcccacctgactgcccgaaatcaccccgcccaccaagtgtcccctcttcttcctggaatagtctcggtgcacagcctcacgtaacagggccctcctgatatggcgagactccgcgctcctcgtcactcacggggcaggcgctgaggaaggaactgtcaggcaccgcggggacgcctttccgagcgcccggctcggcgcggcgcgggggcgcgcacgccgcccagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaaaaaaaataaaaacggcctcccggccctaatgctgagcttcgggcccgttcacttatgaggcgcctcatgacctcctcgatgactctcgcctcgtccgccgctgctacagcgccctacccctcaagctggccaccgccccacacccccggtctctcccgctccacccccctcgccgtcccttaggcctcgcccaagagacacggccaccccccccgcacccgactcccatccccccacaatccgccccccccctttttcccacgcccccgccccccctcctctcccagagtatctcctctacctccccccccccccccacgcctcccctacctactaacaacgcacgcccgcgcatccgccaccgagccggccacccc

SEQ ID NO: 361361 - DNA, 2857 bp, Homo sapiens
  misc_feature (2241)..(2241): n is a, c, g, or t
actgtgtttatgtttttattttgattcatacttggcttgctgaaaaatacgctgtaaatataaaatactgcagtaatgccgacaatcaacatggtgaaaggtgacagtctttttgatttctgctcaactcattattttatacaataagctcagacgaataatacccaatttggataatgttacgcttgacaaaacactttacttcatttagtcctcacaacaaccctgtgaggtaggcacattctcggaggtaaaatgacgtgggcaaagttccctggctcgtttggggaaaggctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccaggtcggtcatgcaggagcccaccactaccaccgccgccacctcctcttgccactgcctctggggttccccagacgccgccatcgctcaaaggtgctgctgtccaacctggacggtgacctctgccctttgcccgaccccgtaaccagagacgccactcctgccctccctaacgacgcgggcctttcagacgcctacgcgggtcgcccacctgactgcccgaaatcaccccgcccaccaagtgtcccctcttcttcctggaatagtctcggtgcacagcctcacgtaacagggccctcctgatatggcgagactccgcgctcctcgtcactcacggggcaggcgctgaggaaggaactgtcaggcaccgcggggacgcctttccgagcgcccggctcggcgcggcgcgggggcgcgcacgccgcccagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctgggggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagggatgccangggagcagagatgcctgcagcccgtgggagcaagtcctggcctttgcagttgcaaaaactggctgcaagctgctccagccccagaggaactggccaagctccagagggcctccttggagggcctcagagggagagagaactgctcagtaattttgatcactttgggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 361362 - DNA, 1607 bp, Homo sapiens
  misc_feature (991)..(991): n is a, c, g, or t
agctctctcttttcctgctgctatccattgtaagatgtgacttgctccgccttgccttctgccacgattgtgtgaggcttccccagccacatgtcactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagggatgccangggagcagagatgcctgcagcccgtgggagcaagtcctggcctttgcagttgcaaaaactggctgcaagctgctccagccccagaggaactggccaagctccagagggcctccttggagggcctcagagggagagagaactgctcagtaattttgatcactttgggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 361363 - DNA, 2717 bp, Homo sapiens
actgtgtttatgtttttattttgattcatacttggcttgctgaaaaatacgctgtaaatataaaatactgcagtaatgccgacaatcaacatggtgaaaggtgacagtctttttgatttctgctcaactcattattttatacaataagctcagacgaataatacccaatttggataatgttacgcttgacaaaacactttacttcatttagtcctcacaacaaccctgtgaggtaggcacattctcggaggtaaaatgacgtgggcaaagttccctggctcgtttggggaaaggctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccaggtcggtcatgcaggagcccaccactaccaccgccgccacctcctcttgccactgcctctggggttccccagacgccgccatcgctcaaaggtgctgctgtccaacctggacggtgacctctgccctttgcccgaccccgtaaccagagacgccactcctgccctccctaacgacgcgggcctttcagacgcctacgcgggtcgcccacctgactgcccgaaatcaccccgcccaccaagtgtcccctcttcttcctggaatagtctcggtgcacagcctcacgtaacagggccctcctgatatggcgagactccgcgctcctcgtcactcacggggcaggcgctgaggaaggaactgtcaggcaccgcggggacgcctttccgagcgcccggctcggcgcggcgcgggggcgcgcacgccgcccagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 361364 - DNA, 2565 bp, Homo sapiens
actgtgtttatgtttttattttgattcatacttggcttgctgaaaaatacgctgtaaatataaaatactgcagtaatgccgacaatcaacatggtgaaaggtgacagtctttttgatttctgctcaactcattattttatacaataagctcagacgaataatacccaatttggataatgttacgcttgacaaaacactttacttcatttagtcctcacaacaaccctgtgaggtaggcacattctcggaggtaaaatgacgtgggcaaagttccctggctcgtttggggaaaggctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccaggtcggtcatgcaggagcccaccactaccaccgccgccacctcctcttgccactgcctctggggttccccagacgccgccatcgctcaaaggtgctgctgtccaacctggacggtgacctctgccctttgcccgaccccgtaaccagagacgccactcctgccctccctaacgacgcgggcctttcagacgcctacgcgggtcgcccacctgactgcccgaaatcaccccgcccaccaagtgtcccctcttcttcctggaatagtctcggtgcacagcctcacgtaacagggccctcctgatatggcgagactccgcgctcctcgtcactcacggggcaggcgctgaggaaggaactgtcaggcaccgcggggacgcctttccgagcgcccggctcggcgcggcgcgggggcgcgcacgccgcccagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 361365 - DNA, 1497 bp, Homo sapiens
  misc_feature (17)..(17): n is a, c, g, or t
  misc_feature (61)..(61): n is a, c, g, or t
  misc_feature (70)..(70): n is a, c, g, or t
  misc_feature (144)..(144): n is a, c, g, or t
  misc_feature (150)..(150): n is a, c, g, or t
  misc_feature (157)..(157): n is a, c, g, or t
  misc_feature (177)..(177): n is a, c, g, or t
  misc_feature (208)..(208): n is a, c, g, or t
  misc_feature (238)..(238): n is a, c, g, or t
  misc_feature (246)..(246): n is a, c, g, or t
  misc_feature (251)..(251): n is a, c, g, or t
  misc_feature (254)..(254): n is a, c, g, or t
  misc_feature (257)..(264): n is a, c, g, or t
  misc_feature (266)..(267): n is a, c, g, or t
  misc_feature (270)..(276): n is a, c, g, or t
  misc_feature (278)..(278): n is a, c, g, or t
  misc_feature (284)..(284): n is a, c, g, or t
  misc_feature (288)..(289): n is a, c, g, or t
  misc_feature (291)..(292): n is a, c, g, or t
  misc_feature (297)..(297): n is a, c, g, or t
  misc_feature (301)..(301): n is a, c, g, or t
  misc_feature (305)..(305): n is a, c, g, or t
  misc_feature (332)..(332): n is a, c, g, or t
  misc_feature (350)..(351): n is a, c, g, or t
  misc_feature (353)..(353): n is a, c, g, or t
  misc_feature (358)..(359): n is a, c, g, or t
  misc_feature (367)..(367): n is a, c, g, or t
  misc_feature (372)..(372): n is a, c, g, or t
  misc_feature (376)..(376): n is a, c, g, or t
  misc_feature (380)..(380): n is a, c, g, or t
taacccgaagtgaaggntctagatccagggaccaccagccagctcaagtggatttcagcantcggggctncctggggcgtgcaaaagctgctgtgtgagcaaaaacgctgccgtgaagacattccaggcggcttccaggaagcngctgtntgtgctnacacgcatgtgcacaggcantctggctggccacctctcaagactggtgttncctagagcttaccattggcaaaagctgcancctggaantaagnaanaannnnnnnnanntannnnnnngntctttnggcnntnncattnccancccntctggggctgtacggataatttttttnggcctgggagtaaagctnncnactgnnggtaaagngatanacgnactnaaatgtgagagttggctgttctcgagggaaaaacagaggcaggtcaatgtgtacaagaaaacaactagtacaactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 361366 - DNA, 513 bp, Homo sapiens
  misc_feature (17)..(17): n is a, c, g, or t
aaaagaaaaaaaggganggaggggaggggggaaaggggagtggcacgagacgagggcctagggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 361367 - DNA, 494 bp, Homo sapiens
gcttcatccggcccacacacgccccccgcccgccggcttaagggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 361368 - DNA, 1860 bp, Homo sapiens
actgtgtttatgtttttattttgattcatacttggcttgctgaaaaatacgctgtaaatataaaatactgcagtaatgccgacaatcaacatggtgaaaggtgacagtctttttgatttctgctcaactcattattttatacaataagctcagacgaataatacccaatttggataatgttacgcttgacaaaacactttacttcatttagtcctcacaacaaccctgtgaggtaggcacattctcggaggtaaaatgacgtgggcaaagttccctggctcgtttggggaaaggctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccaggtcggtcatgcaggagcccaccactaccaccgccgccacctcctcttgccactgcctctggggttccccagacgccgccatcgctcaaaggtgctgctgtccaacctggacggtgacctctgccctttgcccgaccccgtaaccagagacgccactcctgccctccctaacgacgcgggcctttcagacgcctacgcgggtcgcccacctgactgcccgaaatcaccccgcccaccaagtgtcccctcttcttcctggaatagtctcggtgcacagcctcacgtaacagggccctcctgatatggcgagactccgcgctcctcgtcactcacggggcaggcgctgaggaaggaactgtcaggcaccgcggggacgcctttccgagcgcccggctcggcgcggcgcgggggcgcgcacgccgcccagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactgggggtaaggatttttgagaatggaaaaaaagatgacttcatccataataaaataatcaattcataacaaaaaaaattaacgctaataatattaacataaaaatagaacaacggaggaaaaaaataaatatggccttattggcctca

SEQ ID NO: 361369 - DNA, 360 bp, Homo sapiens
gaggacactgaagccacccaggtgtaccccaagctgtacttgtcacctcgaattgagcagtaagtgtcattaacatgaggtagcctggtgctacttcttgctaaccaatatgtctcattctttcttttgccactcttgaactcttacatttatttctcttcattgacttttgttttcttaaaaaattcatcatattaagagtttccattgcagagtaaatgcagttagtacttgccactacacccttttggcaagtgttattgtgcatttagtgacatgaatactgtacctttgtagagagaaaagaataggcagactgagtccaaaattgagactccttccagatgttccctggagttc

SEQ ID NO: 361370 - DNA, 488 bp, Homo sapiens
cgcacactgcgcttgtcgaaccacacagaggcttcaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 361371 - DNA, 2934 bp, Homo sapiens
  misc_feature (2318)..(2318): n is a, c, g, or t
actgtgtttatgtttttattttgattcatacttggcttgctgaaaaatacgctgtaaatataaaatactgcagtaatgccgacaatcaacatggtgaaaggtgacagtctttttgatttctgctcaactcattattttatacaataagctcagacgaataatacccaatttggataatgttacgcttgacaaaacactttacttcatttagtcctcacaacaaccctgtgaggtaggcacattctcggaggtaaaatgacgtgggcaaagttccctggctcgtttggggaaaggctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccaggtcggtcatgcaggagcccaccactaccaccgccgccacctcctcttgccactgcctctggggttccccagacgccgccatcgctcaaaggtgctgctgtccaacctggacggtgacctctgccctttgcccgaccccgtaaccagagacgccactcctgccctccctaacgacgcgggcctttcagacgcctacgcgggtcgcccacctgactgcccgaaatcaccccgcccaccaagtgtcccctcttcttcctggaatagtctcggtgcacagcctcacgtaacagggccctcctgatatggcgagactccgcgctcctcgtcactcacggggcaggcgctgaggaaggaactgtcaggcaccgcggggacgcctttccgagcgcccggctcggcgcggcgcgggggcgcgcacgccgcccagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagggatgccangggagcagagatgcctgcagcccgtgggagcaagtcctggcctttgcagttgcaaaaactggctgcaagctgctccagccccagaggaactggccaagctccagagggcctccttggagggcctcagagggagagagaactgctcagtaattttgatcactttgggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 361372 - DNA, 2826 bp, Homo sapiens
actgtgtttatgtttttattttgattcatacttggcttgctgaaaaatacgctgtaaatataaaatactgcagtaatgccgacaatcaacatggtgaaaggtgacagtctttttgatttctgctcaactcattattttatacaataagctcagacgaataatacccaatttggataatgttacgcttgacaaaacactttacttcatttagtcctcacaacaaccctgtgaggtaggcacattctcggaggtaaaatgacgtgggcaaagttccctggctcgtttggggaaaggctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccaggtcggtcatgcaggagcccaccactaccaccgccgccacctcctcttgccactgcctctggggttccccagacgccgccatcgctcaaaggtgctgctgtccaacctggacggtgacctctgccctttgcccgaccccgtaaccagagacgccactcctgccctccctaacgacgcgggcctttcagacgcctacgcgggtcgcccacctgactgcccgaaatcaccccgcccaccaagtgtcccctcttcttcctggaatagtctcggtgcacagcctcacgtaacagggccctcctgatatggcgagactccgcgctcctcgtcactcacggggcaggcgctgaggaaggaactgtcaggcaccgcggggacgcctttccgagcgcccggctcggcgcggcgcgggggcgcgcacgccgcccagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagaagcaagagataaagtaataatgggtactgtggggaaaaacacagaagaacaattcggtaatatagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 361373 - DNA, 2964 bp, Homo sapiens
  misc_feature (2318)..(2318): n is a, c, g, or t
actgtgtttatgtttttattttgattcatacttggcttgctgaaaaatacgctgtaaatataaaatactgcagtaatgccgacaatcaacatggtgaaaggtgacagtctttttgatttctgctcaactcattattttatacaataagctcagacgaataatacccaatttggataatgttacgcttgacaaaacactttacttcatttagtcctcacaacaaccctgtgaggtaggcacattctcggaggtaaaatgacgtgggcaaagttccctggctcgtttggggaaaggctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccaggtcggtcatgcaggagcccaccactaccaccgccgccacctcctcttgccactgcctctggggttccccagacgccgccatcgctcaaaggtgctgctgtccaacctggacggtgacctctgccctttgcccgaccccgtaaccagagacgccactcctgccctccctaacgacgcgggcctttcagacgcctacgcgggtcgcccacctgactgcccgaaatcaccccgcccaccaagtgtcccctcttcttcctggaatagtctcggtgcacagcctcacgtaacagggccctcctgatatggcgagactccgcgctcctcgtcactcacggggcaggcgctgaggaaggaactgtcaggcaccgcggggacgcctttccgagcgcccggctcggcgcggcgcgggggcgcgcacgccgcccagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagggatgccangggagcagagatgcctgcagcccgtgggagcaagtcctggcctttgcagttgcaaaaactggctgcaagctgctccagccccagaggaactggccaagctccagagggcctccttggagggcctcagagggagagagaactgctcagtaattttgatcactttgggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaaaaaaaaaaacaaatgggctaactggactca

SEQ ID NO: 361374 - DNA, 2786 bp, Homo sapiens
actgtgtttatgtttttattttgattcatacttggcttgctgaaaaatacgctgtaaatataaaatactgcagtaatgccgacaatcaacatggtgaaaggtgacagtctttttgatttctgctcaactcattattttatacaataagctcagacgaataatacccaatttggataatgttacgcttgacaaaacactttacttcatttagtcctcacaacaaccctgtgaggtaggcacattctcggaggtaaaatgacgtgggcaaagttccctggctcgtttggggaaaggctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccaggtcggtcatgcaggagcccaccactaccaccgccgccacctcctcttgccactgcctctggggttccccagacgccgccatcgctcaaaggtgctgctgtccaacctggacggtgacctctgccctttgcccgaccccgtaaccagagacgccactcctgccctccctaacgacgcgggcctttcagacgcctacgcgggtcgcccacctgactgcccgaaatcaccccgcccaccaagtgtcccctcttcttcctggaatagtctcggtgcacagcctcacgtaacagggccctcctgatatggcgagactccgcgctcctcgtcactcacggggcaggcgctgaggaaggaactgtcaggcaccgcggggacgcctttccgagcgcccggctcggcgcggcgcgggggcgcgcacgccgcccagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaaaaaaaaaatcgggctcgttgggctca

SEQ ID NO: 361375 - DNA, 3163 bp, Homo sapiens
actgtgtttatgtttttattttgattcatacttggcttgctgaaaaatacgctgtaaatataaaatactgcagtaatgccgacaatcaacatggtgaaaggtgacagtctttttgatttctgctcaactcattattttatacaataagctcagacgaataatacccaatttggataatgttacgcttgacaaaacactttacttcatttagtcctcacaacaaccctgtgaggtaggcacattctcggaggtaaaatgacgtgggcaaagttccctggctcgtttggggaaaggctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccaggtcggtcatgcaggagcccaccactaccaccgccgccacctcctcttgccactgcctctggggttccccagacgccgccatcgctcaaaggtgctgctgtccaacctggacggtgacctctgccctttgcccgaccccgtaaccagagacgccactcctgccctccctaacgacgcgggcctttcagacgcctacgcgggtcgcccacctgactgcccgaaatcaccccgcccaccaagtgtcccctcttcttcctggaatagtctcggtgcacagcctcacgtaacagggccctcctgatatggcgagactccgcgctcctcgtcactcacggggcaggcgctgaggaaggaactgtcaggcaccgcggggacgcctttccgagcgcccggctcggcgcggcgcgggggcgcgcacgccgcccagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagtaagtgaatctgtcgttatttccaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaaaaaaaataaaaacggcctcccggccctaatgctgagcttcgggcccgttcacttatgaggcgcctcatgacctcctcgatgactctcgcctcgtccgccgctgctacagcgccctacccctcaagctggccaccgccccacacccccggtctctcccgctccacccccctcgccgtcccttaggcctcgcccaagagacacggccaccccccccgcacccgactcccatccccccacaatccgccccccccctttttcccacgcccccgccccccctcctctcccagagtatctcctctacctccccccccccccccacgcctcccctacctactaacaacgcacgcccgcgcatccgccaccgagccggccacccc

SEQ ID NO: 361376 - DNA, 1556 bp, Homo sapiens
  misc_feature (940)..(940): n is a, c, g, or t
ccagaagcagatgctggcaccatgcttcctgtacagcctgcagaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagggatgccangggagcagagatgcctgcagcccgtgggagcaagtcctggcctttgcagttgcaaaaactggctgcaagctgctccagccccagaggaactggccaagctccagagggcctccttggagggcctcagagggagagagaactgctcagtaattttgatcactttgggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 361377 - DNA, 2685 bp, Homo sapiens
actgtgtttatgtttttattttgattcatacttggcttgctgaaaaatacgctgtaaatataaaatactgcagtaatgccgacaatcaacatggtgaaaggtgacagtctttttgatttctgctcaactcattattttatacaataagctcagacgaataatacccaatttggataatgttacgcttgacaaaacactttacttcatttagtcctcacaacaaccctgtgaggtaggcacattctcggaggtaaaatgacgtgggcaaagttccctggctcgtttggggaaaggctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccaggtcggtcatgcaggagcccaccactaccaccgccgccacctcctcttgccactgcctctggggttccccagacgccgccatcgctcaaaggtgctgctgtccaacctggacggtgacctctgccctttgcccgaccccgtaaccagagacgccactcctgccctccctaacgacgcgggcctttcagacgcctacgcgggtcgcccacctgactgcccgaaatcaccccgcccaccaagtgtcccctcttcttcctggaatagtctcggtgcacagcctcacgtaacagggccctcctgatatggcgagactccgcgctcctcgtcactcacggggcaggcgctgaggaaggaactgtcaggcaccgcggggacgcctttccgagcgcccggctcggcgcggcgcgggggcgcgcacgccgcccagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactgggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 361378 - DNA, 2286 bp, Homo sapiens
actgtgtttatgtttttattttgattcatacttggcttgctgaaaaatacgctgtaaatataaaatactgcagtaatgccgacaatcaacatggtgaaaggtgacagtctttttgatttctgctcaactcattattttatacaataagctcagacgaataatacccaatttggataatgttacgcttgacaaaacactttacttcatttagtcctcacaacaaccctgtgaggtaggcacattctcggaggtaaaatgacgtgggcaaagttccctggctcgtttggggaaaggctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccaggtcggtcatgcaggagcccaccactaccaccgccgccacctcctcttgccactgcctctggggttccccagacgccgccatcgctcaaaggtgctgctgtccaacctggacggtgacctctgccctttgcccgaccccgtaaccagagacgccactcctgccctccctaacgacgcgggcctttcagacgcctacgcgggtcgcccacctgactgcccgaaatcaccccgcccaccaagtgtcccctcttcttcctggaatagtctcggtgcacagcctcacgtaacagggccctcctgatatggcgagactccgcgctcctcgtcactcacggggcaggcgctgaggaaggaactgtcaggcaccgcggggacgcctttccgagcgcccggctcggcgcggcgcgggggcgcgcacgccgcccagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcaagatgggatctcgctatgtgtgtatgcccaggctggtctcaaactcctgagctcacataatcaccaacctacacctcctgaagtgctggggattgcagggccgaggccacacacttgtccagacctggctctttaaagttaggcggagaattttccattcctcctggaaccacatccgttgcccttggaggtctcccggttttctatccccgctttcccgggaggggggctccattgatcgttccccagtttccccgtccccacagggcgtcgcgctccggttcccccgagcggtttggcgttcccccttggccgggttggttttgacgttacacccctggtggggttgtttacgcctctccccaccactgcttctcgggtcccgc

SEQ ID NO: 361379 - DNA, 1779 bp, Homo sapiens
actgtgtttatgtttttattttgattcatacttggcttgctgaaaaatacgctgtaaatataaaatactgcagtaatgccgacaatcaacatggtgaaaggtgacagtctttttgatttctgctcaactcattattttatacaataagctcagacgaataatacccaatttggataatgttacgcttgacaaaacactttacttcatttagtcctcacaacaaccctgtgaggtaggcacattctcggaggtaaaatgacgtgggcaaagttccctggctcgtttggggaaaggctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccaggtcggtcatgcaggagcccaccactaccaccgccgccacctcctcttgccactgcctctggggttccccagacgccgccatcgctcaaaggtgctgctgtccaacctggacggtgacctctgccctttgcccgaccccgtaaccagagacgccactcctgccctccctaacgacgcgggcctttcagacgcctacgcgggtcgcccacctgactgcccgaaatcaccccgcccaccaagtgtcccctcttcttcctggaatagtctcggtgcacagcctcacgtaacagggccctcctgatatggcgagactccgcgctcctcgtcactcacggggcaggcgctgaggaaggaactgtcaggcaccgcggggacgcctttccgagcgcccggctcggcgcggcgcgggggcgcgcacgccgcccagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactgggggtaaggatttttgagaatggaaaaaaagatgacttcatccataataaaataatcaattcata

SEQ ID NO: 361380 - DNA, 2016 bp, Homo sapiens
actgtgtttatgtttttattttgattcatacttggcttgctgaaaaatacgctgtaaatataaaatactgcagtaatgccgacaatcaacatggtgaaaggtgacagtctttttgatttctgctcaactcattattttatacaataagctcagacgaataatacccaatttggataatgttacgcttgacaaaacactttacttcatttagtcctcacaacaaccctgtgaggtaggcacattctcggaggtaaaatgacgtgggcaaagttccctggctcgtttggggaaaggctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccaggtcggtcatgcaggagcccaccactaccaccgccgccacctcctcttgccactgcctctggggttccccagacgccgccatcgctcaaaggtgctgctgtccaacctggacggtgacctctgccctttgcccgaccccgtaaccagagacgccactcctgccctccctaacgacgcgggcctttcagacgcctacgcgggtcgcccacctgactgcccgaaatcaccccgcccaccaagtgtcccctcttcttcctggaatagtctcggtgcacagcctcacgtaacagggccctcctgatatggcgagactccgcgctcctcgtcactcacggggcaggcgctgaggaaggaactgtcaggcaccgcggggacgcctttccgagcgcccggctcggcgcggcgcgggggcgcgcacgccgcccagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagaagcaagagataaagtaataatgggtactgtggggaaaaacacagaagaacaattcggtaatatagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagatggagtcttgctctgttgcccaggctagagtggagtggctcaatctcggctcactgcaagctccgcctcccgggttcacgccattctcctgcctcagcctcccgagtagctgggactacaggcgcccgccaccacacctggctagtttttttatatttttagtagagatggggtttcaccatgttagccaggatggtctccatctcctgacctcatgatctgcccacctcggcctcccaaagtgctgggattacaggcgtgagccactgcacctggcccctcatgagttcttaattttagagaatatgttcttcagttttacaattctatttgattattttctgtaaattccaattatctggttaacttatcttttcatctatatctaaatggctttctccactttcttgcttgtgttaattgtatttg

SEQ ID NO: 361381 - DNA, 1708 bp, Homo sapiens
gggagtcttacaggggcggagcttaaggtgccggaggtctcaggggaggggcctgggggcagcggcttccgtcctggctgtgagcctggaactgaaaaatgcccgaaagtggggcggggcttgagagtctaggtggggcccaggccgggtcgcggccctttcaccactcccacccgtcacctcgccgtgtctgctgacccccaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctgg

SEQ ID NO: 361382 - DNA, 309 bp, Homo sapiens
tcaagcttctaacgatgtacggggacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctgg

SEQ ID NO: 361383 - DNA, 328 bp, Homo sapiens
cagctggtaccggcatgtgctgtaggccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctggcctacagcacatgccggtaccggctg

SEQ ID NO: 361384 - DNA, 1883 bp, Homo sapiens
aacggctagtagagctgggtgttaatcggccgagggcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctgg

SEQ ID NO: 361385 - DNA, 2195 bp, Homo sapiens
gactttgtcccccgagatggatgggggcggacatggggagccaggggatgggactgcctggtaggtgctgctgcccacgaagggggagtaggtggcagtgtggctccgaggagattctggctttggagttctggtcctctgcctgtttcccctgcagtgtctctgacccagaccccctacctacccccccggaggcccagcttccctgcccagctccaccccctggcttgtggctgggctcatgtgtagcctcattgtcctcttgtaaaggggggataggcagccatgagcccctgggggctgcggagcgagcgaggtgaacctatacgcgccgcgctcgtggacgcctggccacttccgccaggcggggacccgatggccacggtggctctgggttgtcgggcctcgaaccgggtctccagacgttgggcccctccctcccagcgcgggagaggcggggaagggggcggggcgggggaggggccgcagcgcttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctgg

SEQ ID NO: 361386 - DNA, 2450 bp, Homo sapiens
gactttgtcccccgagatggatgggggcggacatggggagccaggggatgggactgcctggtaggtgctgctgcccacgaagggggagtaggtggcagtgtggctccgaggagattctggctttggagttctggtcctctgcctgtttcccctgcagtgtctctgacccagaccccctacctacccccccggaggcccagcttccctgcccagctccaccccctggcttgtggctgggctcatgtgtagcctcattgtcctcttgtaaaggggggataggcagccatgagcccctgggggctgcggagcgagcgaggtgaacctatacgcgccgcgctcgtggacgcctggccacttccgccaggcggggacccgatggccacggtggctctgggttgtcgggcctcgaaccgggtctccagacgttgggcccctccctcccagcgcgggagaggcggggaagggggcggggcgggggaggggccgcagcgcttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggggcggagccctgggccggggtggggcgggatgggagatggggtctggaggggcccaggatccgggcagggccgagtgtgagggtccccccaggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctgg

SEQ ID NO: 361387 - DNA, 2306 bp, Homo sapiens
gactttgtcccccgagatggatgggggcggacatggggagccaggggatgggactgcctggtaggtgctgctgcccacgaagggggagtaggtggcagtgtggctccgaggagattctggctttggagttctggtcctctgcctgtttcccctgcagtgtctctgacccagaccccctacctacccccccggaggcccagcttccctgcccagctccaccccctggcttgtggctgggctcatgtgtagcctcattgtcctcttgtaaaggggggataggcagccatgagcccctgggggctgcggagcgagcgaggtgaacctatacgcgccgcgctcgtggacgcctggccacttccgccaggcggggacccgatggccacggtggctctgggttgtcgggcctcgaaccgggtctccagacgttgggcccctccctcccagcgcgggagaggcggggaagggggcggggcgggggaggggccgcagcgcttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctgg

SEQ ID NO: 361388 - DNA, 2062 bp, Homo sapiens
gactttgtcccccgagatggatgggggcggacatggggagccaggggatgggactgcctggtaggtgctgctgcccacgaagggggagtaggtggcagtgtggctccgaggagattctggctttggagttctggtcctctgcctgtttcccctgcagtgtctctgacccagaccccctacctacccccccggaggcccagcttccctgcccagctccaccccctggcttgtggctgggctcatgtgtagcctcattgtcctcttgtaaaggggggataggcagccatgagcccctgggggctgcggagcgagcgaggtgaacctatacgcgccgcgctcgtggacgcctggccacttccgccaggcggggacccgatggccacggtggctctgggttgtcgggcctcgaaccgggtctccagacgttgggcccctccctcccagcgcgggagaggcggggaagggggcggggcgggggaggggccgcagcgcttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctgg

SEQ ID NO: 361389 - DNA, 1842 bp, Homo sapiens
aacggctagtagagctgggtgttaatcggccgaggccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgaaaaaaaacaacagtatgtatacccatctctattttctcttacacatagaaa

SEQ ID NO: 361390 - DNA, 1471 bp, Homo sapiens
  misc_feature (22)..(22): n is a, c, g, or t
acattacggctaggtacgaggnctcgggtttaccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctgg

SEQ ID NO: 361391 - DNA, 1339 bp, Homo sapiens
gactttgtcccccgagatggatgggggcggacatggggagccaggggatgggactgcctggtaggtgctgctgcccacgaagggggagtaggtggcagtgtggctccgaggagattctggctttggagttctggtcctctgcctgtttcccctgcagtgtctctgacccagaccccctacctacccccccggaggcccagcttccctgcccagctccaccccctggcttgtggctgggctcatgtgtagcctcattgtcctcttgtaaaggggggataggcagccatgagcccctgggggctgcggagcgagcgaggtgaacctatacgcgccgcgctcgtggacgcctggccacttccgccaggcggggacccgatggccacggtggctctgggttgtcgggcctcgaaccgggtctccagacgttgggcccctccctcccagcgcgggagaggcggggaagggggcggggcgggggaggggccgcagcgcttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggggcggagccctgggccggggtggggcgggatgggagatggggtctggaggggcccaggatccgggcagggccgagtgtgagggtccccccaggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcaggtgctgtcccatcccgcatcccttgcttcctgccacctgttcttcgccacttggttccctcttttt

SEQ ID NO: 361392 - DNA, 714 bp, Homo sapiens
gactttgtcccccgagatggatgggggcggacatggggagccaggggatgggactgcctggtaggtgctgctgcccacgaagggggagtaggtggcagtgtggctccgaggagattctggctttggagttctggtcctctgcctgtttcccctgcagtgtctctgacccagaccccctacctacccccccggaggcccagcttccctgcccagctccaccccctggcttgtggctgggctcatgtgtagcctcattgtcctcttgtaaaggggggataggcagccatgagcccctgggggctgcggagcgagcgaggtgaacctatacgcgccgcgctcgtggacgcctggccacttccgccaggcggggacccgatggccacggtggctctgggttgtcgggcctcgaaccgggtctccagacgttgggcccctccctcccagcgcgggagaggcggggaagggggcggggcgggggaggggccgcagcgcttttctccggaggtcgcgcgcccgagagcccgcgctgtccgccgccgctgcctgagtcgactctgcgccggtgagtgcggttcggggcagggacggcctccgtggggacccaggctggcttggccccggccgcttagagtccccgctgaccccccccccacgaccctaccttgaaggcccccacaaataaaggcgctgccactcagccctccttccacctgg

SEQ ID NO: 361393 - DNA, 1859 bp, Homo sapiens
aacggctagtagagctgggtgttaatcggccgaggccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctgg

SEQ ID NO: 361394 - DNA, 2357 bp, Homo sapiens
gactttgtcccccgagatggatgggggcggacatggggagccaggggatgggactgcctggtaggtgctgctgcccacgaagggggagtaggtggcagtgtggctccgaggagattctggctttggagttctggtcctctgcctgtttcccctgcagtgtctctgacccagaccccctacctacccccccggaggcccagcttccctgcccagctccaccccctggcttgtggctgggctcatgtgtagcctcattgtcctcttgtaaaggggggataggcagccatgagcccctgggggctgcggagcgagcgaggtgaacctatacgcgccgcgctcgtggacgcctggccacttccgccaggcggggacccgatggccacggtggctctgggttgtcgggcctcgaaccgggtctccagacgttgggcccctccctcccagcgcgggagaggcggggaagggggcggggcgggggaggggccgcagcgcttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctgg

SEQ ID NO: 361395 - DNA, 2461 bp, Homo sapiens
gactttgtcccccgagatggatgggggcggacatggggagccaggggatgggactgcctggtaggtgctgctgcccacgaagggggagtaggtggcagtgtggctccgaggagattctggctttggagttctggtcctctgcctgtttcccctgcagtgtctctgacccagaccccctacctacccccccggaggcccagcttccctgcccagctccaccccctggcttgtggctgggctcatgtgtagcctcattgtcctcttgtaaaggggggataggcagccatgagcccctgggggctgcggagcgagcgaggtgaacctatacgcgccgcgctcgtggacgcctggccacttccgccaggcggggacccgatggccacggtggctctgggttgtcgggcctcgaaccgggtctccagacgttgggcccctccctcccagcgcgggagaggcggggaagggggcggggcgggggaggggccgcagcgcttttctccggaggtcgcgcgcccgagagcccgcgctgtccgccgccgctgcctgagtcgactctgcgccggtgagtgcggttcggggcagggacggcctccgtggggacccaggctggcttggccccggccgcttagagtccccgctgaccccctgctcaccccgggcccccagcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctgg

SEQ ID NO: 361396 - DNA, 2186 bp, Homo sapiens
aacggctagtagagctgggtgttaatcggccgaggccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctggggttcttggggcctgtgacctgactctgcctccctctacttccccgactcttgagcgcccagcttcagtcccatcccctctgcccatggtcatcaccccaactcccagggagagcccagaacctggagcctcgctctgcccccagttctcaaaggtggggctagatgggggcggggacggaacaagaccacagggtggagagtgtggtggcagaaggccaaagagggaatctgagacaagctaccaaaaaccaaaaccagcttccatttatttatgggccccaccccctgacgtcctggggagaggggccccccaaagagcctttct

SEQ ID NO: 361397 - DNA, 2301 bp, Homo sapiens
gactttgtcccccgagatggatgggggcggacatggggagccaggggatgggactgcctggtaggtgctgctgcccacgaagggggagtaggtggcagtgtggctccgaggagattctggctttggagttctggtcctctgcctgtttcccctgcagtgtctctgacccagaccccctacctacccccccggaggcccagcttccctgcccagctccaccccctggcttgtggctgggctcatgtgtagcctcattgtcctcttgtaaaggggggataggcagccatgagcccctgggggctgcggagcgagcgaggtgaacctatacgcgccgcgctcgtggacgcctggccacttccgccaggcggggacccgatggccacggtggctctgggttgtcgggcctcgaaccgggtctccagacgttgggcccctccctcccagcgcgggagaggcggggaagggggcggggcgggggaggggccgcagcgcttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctgg

SEQ ID NO: 361398 - DNA, 1973 bp, Homo sapiens
aacggctagtagagctgggtgttaatcggccgaggccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgtcccggtggcgtccccactcccggccaccctccccactctgtctcctggatgctgggattccaggcgggagccgcggtgcctggtcctgttgagcatttaaagctgtcgttccaccgtcttcttggtcttctcgtcttcgttgacctctggctttcagtagggtgactctggtgtgccttgcc

SEQ ID NO: 361399 - DNA, 1494 bp, Homo sapiens
tttataagagagatcccctatccgtcgtatgggcggagccctgggccggggtggggcgggatgggagatggggtctggaggggcccaggatccgggcagggccgagtgtgagggtccccccaggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctgg

SEQ ID NO: 361400 - DNA, 1261 bp, Homo sapiens
gactttgtcccccgagatggatgggggcggacatggggagccaggggatgggactgcctggtaggtgctgctgcccacgaagggggagtaggtggcagtgtggctccgaggagattctggctttggagttctggtcctctgcctgtttcccctgcagtgtctctgacccagaccccctacctacccccccggaggcccagcttccctgcccagctccaccccctggcttgtggctgggctcatgtgtagcctcattgtcctcttgtaaaggggggataggcagccatgagcccctgggggctgcggagcgagcgaggtgaacctatacgcgccgcgctcgtggacgcctggccacttccgccaggcggggacccgatggccacggtggctctgggttgtcgggcctcgaaccgggtctccagacgttgggcccctccctcccagcgcgggagaggcggggaagggggcggggcgggggaggggccgcagcgcttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatgacattctcgatcgcttgaaaccttggccgaggcgaatgcgggcggcgcgaaaggtgccttgggacctgggggggcttgccaggaaggcaaacttggtgagcccggcacccattgggacggccccttgcgggccccgggcccttactggttataccattcgccccgaaatttccatccgcgggccagaggcagaaggcgccgcgccgcggaacaaaccttcaatcccagtgcctcggcgttgccgcaggcagcgtgggaaggcaggaattccggag

SEQ ID NO: 361401 - DNA, 716 bp, Homo sapiens
agcgcagctgcatcgagaacatcctcaggtgcaccccagcctccaggttcccgcccggggcccagatacccccctggctaagctatgcacagggcttggggggctgtaggtggcagggataccccccctttctccctgtgggtgtctggctctgctaagctgtgtgacctctccagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctggggttcttggggcctgtgacctgactctgcctccctctacttccccgactcttgagcgcccagcttcagtcccatcccctctgcccatggtcatcaccccaactcccagggagagcccagaacctggagcctcgctctgcccccagttctcaaaggtggggctagatgggggcggggacggaacaagaccacagggtggagagtgtggtggcagaaggccaaagagg

SEQ ID NO: 361402 - DNA, 527 bp, Homo sapiens
tgaggtcgtctagaggatcccggaagcacctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcagtgtgcttccggggtaccgagctcg

SEQ ID NO: 361403 - DNA, 417 bp, Homo sapiens
ttttttttttcagtattttccttcactttaatttttattgcttctccagttcaaataattcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtga

SEQ ID NO: 361404 - DNA, 386 bp, Homo sapiens
  misc_feature (88)..(88): n is a, c, g, or t
cttgggctttctctgtgtgtgtagttttgtaaacactaaggcgcccaaaatttttcccttgggggtttttaaaaaaaaaggaaatttnccccacgtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtga

SEQ ID NO: 361405 - DNA, 933 bp, Homo sapiens
cctctccgctgggagaggccagttaaagtctagacactgtctgcttggctctgtgcctttttagcacaatctgcatggttctgtagctcttactttggttgtctgtcctcactcgtttccccagttttcttagttaggcttaaactgtcccgggggactggcaacgagtcgcacacataggaaacaggtgagtgaatttatgagactgtcaggattcagctgccttgaaaggttcagagtgaagatagcagcagtgctgactgaaactgtggctgagtttacagacatccctggtgtgagctggcttcaaacgaacctccatttactggccagagatgggctgggatgaataactcaggacagacagtggcaccccaggtaatgagcagccacctgactcctcatctgccaaatatgggggttagagtaggtgggctctaaaatgcagctttgaagtcctattcatataaaaggaggcggatattctaggctagactgtcaaaatattctacttaatggaattgggatatttgattaactcttatggtgatttacagcctagtgaagaacagtttgaaagataggctggctcaagaatgagaaaacagagtgaataaaaacaggaggcatcttgtgtcctttactttctctcgccatgtagtgagtggaatataaacagtacggcatgtggcacctgaacagtcttcatgcccaggaatcccaaatgctgtttactctacagaaaggaatcacttgattttccacttcagaagccaaccgctcaacaacactggggaagaaatgaagaatcctgggtctccttgtagtcgatcaagaaattttggggggaaaaagggaagacaacccctaattcagagtgtgcagtttgggatttattgaacttacttgaaaaacaaaagcaaacaaaactta

SEQ ID NO: 361406 - DNA, 3745 bp, Homo sapiens
aaaataaaaaacaaaaaaaaacaacagagtattatacgtcgtgctgggtttattagtacgagggatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtga

SEQ ID NO: 361407 - DNA, 3841 bp, Homo sapiens
  misc_feature (3787)..(3787): n is a, c, g, or t
  misc_feature (3791)..(3791): n is a, c, g, or t
  misc_feature (3793)..(3794): n is a, c, g, or t
ggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtgaaaaaaccacnacancnncacacaaaaaacgcacaaaacaaaaaacacaaccaacaacacccacg

SEQ ID NO: 361408 - DNA, 3123 bp, Homo sapiens
ggagtctgttgggggatgggggactgggggagggatagcattgggagaggtgcctgaagtgggtgacgggttgatggtagtgtttgctcagatatagtgcttctgagggacaggcaggtcttgtctgggaaaaaagggtaaggtgcacagactgtagcaaagatgccctgttccaccctcacagctaaactgttgccccgtatttctggcccaacagagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtga

SEQ ID NO: 361409 - DNA, 2930 bp, Homo sapiens
agaaaatgtgggtaattcacctctccttccacaagttaaatgggagatgaattgagagcctctaggtagatcttggcggattcctcactggcttaccacagctgctactgctctgagctttggttcttcttgcaggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtga

SEQ ID NO: 361410 - DNA, 4128 bp, Homo sapiens
  misc_feature (3778)..(3778): n is a, c, g, or t
  misc_feature (3784)..(3784): n is a, c, g, or t
  misc_feature (3789)..(3789): n is a, c, g, or t
  misc_feature (3798)..(3798): n is a, c, g, or t
ggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtganaaacancacanacaacaaancacccgctaccacacaaaggagcaccacacacaacgaacagcacagcaccaaggccacaaacaagaccacacagcaaccaattcgataggacaagaaacaaccaaacaagaagcaacaatcataagacagaagaaaccggaggagacgggacagacgaacacaactgaggcgcgacgagcacacgccgcaaccacttctgagagagatagacactaccgtaataccaaccacaagcgtacacgtgcgaaaaagaacaagaacacatagtgtagacgagaactactagtgataggtaatacaccaatcgcctacccaaactacagttcgag

SEQ ID NO: 361411 - DNA, 3684 bp, Homo sapiens
ggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcagtgtgcttccggggtaccgagctcg

SEQ ID NO: 361412 - DNA, 1976 bp, Homo sapiens
ggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtga

SEQ ID NO: 361413 - DNA, 1208 bp, Homo sapiens
gcgttctgaggataacggaagacgagctgaggtggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtga

SEQ ID NO: 361414 - DNA, 3722 bp, Homo sapiens
ggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtga

SEQ ID NO: 361415 - DNA, 950 bp, Homo sapiens
acatgccgtgactctggactatatcagtttttggaaagcagggttcctctgcctgctaacaagcccacgtggaccagtctgaatgtctttcctttacacctatgtttttaagcagtcaaacttcaagaaactatctaaacaagtttctgttgcagtgtgcttgcttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtga

SEQ ID NO: 361416 - DNA, 834 bp, Homo sapiens
cagctcggtaccccatttttgaattcttgtcccatatccatggcacagtgctgtgagggatgagcttccatagtcctcgggcagatctgcacctgcacggcggcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtga

SEQ ID NO: 361417 - DNA, 3400 bp, Homo sapiens
ggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacagatagagagtgttgggggggatctgtagagtcac

SEQ ID NO: 361418 - DNA, 620 bp, Homo sapiens
tgaggtcgtctagaggatcccggaagcacctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtga

SEQ ID NO: 361419 - DNA, 2638 bp, Homo sapiens
ggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggctgactttatcatgacaactctagctgattctttatgaaggattagggatattcatcttcagcagtgcacatgagaaataaactctgaaaaaggcaatttctggggtttaggaaggaccgtattctgggaattacttcagaggaacggacaataattctaggattatagccaagaaggactggaagacttcaggagatgcttcagcttcttctagattttgaatgctgaataagccactgaagtgtgatatctatattatccttttctttgcaagaaattgaatagcagcaaatttctctatcctgaatagcagacagattcattttttcaattagctgtttctcatccaaggcattaggaagacctccctttttccaaggcacatcgaacctgagttagcaggaagggattctccaataagagcagaaatgccaggaaatcctcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttggcccccagctcacagtgctgccctctgacatctgtgaacagtttaacatcaacaagaggatgtccgggtctgagaaagaaccccagtttaagtttatctacttcaaccacatgaatctcgccgagaagagcac

SEQ ID NO: 361420 - DNA, 455 bp, Homo sapiens
aattctatttttggcacaacagtttctcacagttgcctgtgcattacaacctaaataatttccttctgatggtctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtga

SEQ ID NO: 361421 - DNA, 1447 bp, Homo sapiens
ggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggcaggagaatcgcttgaactcgggaggcggaggttgcagtgagccgagatcgcgccactgcactccagcctgggtgacagagtgagactctgtctcaaaaaaaaa

SEQ ID NO: 361422 - DNA, 1019 bp, Homo sapiens
ggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccaggtgagtgcctattttttctactgtgtgcatctcagggaggacattcttttcatgatagaaattttgtgttccacaatccctgccaagctcataagatcttctatgcatcagaattgtgtcccagaactggccactcctcaacacagctcagaaaagctgcaaaactacatttgtgtatgtgtttgccaattgaagcagctggttgggtcagaatgttggctgtgttttcccatttttcctgagtagtgattgaactgcataaacaggaaagccactgagttcatttttcaacatcctataagacatgctcgtgtcatgggaccagcaaatagaaggcacaactctttttgaaaggggataactggaaatgccagtaagacttctgtggttttctattagtgatcactaaaattttatcatgatttatagttacagagcttttttgcacatactttccttagattctcacggtagcctttgtgaagtagatcttattgtaattaccatatag

SEQ ID NO: 361423 - DNA, 791 bp, Homo sapiens
ggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggcattcatcaaatagcatttgatgggtttaaatctttttccttggccattactgaagaagactggaggatttatactctgtacattggccttcaaagtggacaagtcttaggtagacaattggagaggagaaaataagaaccatattcaaacctaacaagctaattcagggcagataaatggtctgtattagaaacttccacttggactttcctaagaaaccgaagggtgaaattatgaaactagtggcagccttacaaaaacattttttaggaagagtgacaagatatcttgggaactcctaagaatcactctgaggagtgttgctttcataatggggagcccgaaagaccctgtcagtagcagtggagtcactgggtgttcctgtgttgagaaggcggtgtggtatgtcacaggggagactctccaactcgtcactgtggaccatgagaacagaagcacctctctcaagtaccggagttggagccacctgggtctgactcttacctcagtcatggcccagctcttgaagtcacagtctcctcagtgcaa

SEQ ID NO: 361424 - DNA, 322 bp, Homo sapiens
gcgaagctgaggtcttgctaacacatttctcctgtgttttgtttcaggggactctgtgttgatgctctcattgaactgtctgatgaaaatgctgattggaaactcagcttccaagagtttctcaagtgcctcaacccatctttcaaccctcctgagaagagtatgcctaacctaagaaatagagagctgtagtgaatggaggcattttgtaggagccaagatagagaggattggtggaactctccagagctagctgagaaaatccccttccatgattctaaactgggccccagcccattctccccatggtgaagttagggcc

SEQ ID NO: 361425 - DNA, 3777 bp, Homo sapiens
ggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtga

SEQ ID NO: 361426 - DNA, 3714 bp, Homo sapiens
ggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtga

SEQ ID NO: 361427 - DNA, 3845 bp, Homo sapiens
ggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtgatagttttattggtttcctttcccccaattaaggccaaataaagtcgtgagaacattacccatttactt

SEQ ID NO: 361428 - DNA, 1995 bp, Homo sapiens
ggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtga

SEQ ID NO: 361429 - DNA, 1433 bp, Homo sapiens
  misc_feature (25)..(25): n is a, c, g, or t
aaaaaaaaaaaaaaaaaaatacagngaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtga

SEQ ID NO: 361430 - DNA, 2659 bp, Homo sapiens
ggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgagcatgaaatgcaaatgtcgaccggccgcgaatttagtagtagtagacccggaattcc

SEQ ID NO: 361431 - DNA, 1668 bp, Homo sapiens
ggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagactctatgacatcatcttacagaat

SEQ ID NO: 361432 - DNA, 1339 bp, Homo sapiens
  misc_feature (1183)..(1183): n is a, c, g, or t
ggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcagaaactcacaaaaaggagaactgaaaatttagacatacagttggccattgtaaaaaacatcagtttcctctcatacattccaagtaaaccaagtaaaataagtgttggagtaacacttgcataanagaatttaaggagtgatagctctttctgttctgccattcccaacattcctgggggaaaggagactcaatgagttaatactatttcacttggagccccaagatggaaactttggttttgaccttaaaacatcttgattaattataggcttagcttga

SEQ ID NO: 361433 - DNA, 649 bp, Homo sapiens
ggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagattgaagtactcatggagcatctcctgtgcagaggcagtaggatgggaagccagcataggttctccctaaaggtagagtgagtgaatggaaataactgggaagaaaacagaaagaaaaggcaaaaaaagagtgagtggaatataaacagtacggcatgtggcacctgaacagtcttcatgcccaggaatcccaaatgctgtttactctacagaaaggaatcacttgattttccacttcagaagccaaccgctcaacaacactggggaagaaatgaagaatcctgggtctccttgtagtcgatcaagaaattttggggggaaaaagggaagacaacccctaattcagagtgtgcagtttgggatttattgaacttacttgaaaaacaaaagcaaacaaaactta

SEQ ID NO: 361434 - DNA, 588 bp, Homo sapiens
cccagcattgataccaacagcagacactattcgtgcttcttttttcaatctgaaaggaccaagattgttattatttttaaatccctctctcctttctttgtcctggcccttcttagggccacctcacctacctccttccaatgtggtaccagtaaaatatagatctccagataaatttgagtttcagatgaacaatgagtaaaatttttggtataagtatgtctcaaacattgcttgggacatactaaaaattattcactgattatttaaattcaggtttaactggtgtcgtgtattttatttgctcaacctggcaagcttcctccccgacaacctcctgcccccagaccctgctcccacccccatgccactcttgccattctctaatgttgagaaatcacaagaataaaattaaaacccttaaggaaaccaaccagttgccttataaacaaaagaagacaaaaaatccctttgctaatcaggaactcccatgactaggtattcaaaactttagacttcaagaagagggagaaataagttctcactgggtcccttctaacagctgaaattaccattaacattattttg

SEQ ID NO: 361435 - DNA, 458 bp, Homo sapiens
actctccaaattcccattctttgcctcataaatgattagctgaactcttttgtccccactggacaaaatgggaacaaaatcaaaatctttggttcatattctctgcttcccccaaggctcctaagtattggcccaccctcaacctgagccagcaggcagtcctgctacttctggaaacagactgggctaggtgcagtggctcacacctgtgatccccttagtttgggaagccgagcctggaggatttcttgagcccaggaattcaagaccagcctgggcaacaaagtgagactccatctctacaaaaaatttaaaaattagccagatgtagtagtgcatgcctgtagacccaactagtcaggaggctgaggtaggagaatcacttgagcccaggaggttgaggctgcagtgagccatattcatgccactgcactccagccttgctgacagagtgagac

SEQ ID NO: 361436 - DNA, 1203 bp, Homo sapiens
cacctcttgaaatacacaaaactcttctagtttcctggttgaccgacccagggcttgacgactccttttgagccacctgacaattcagtccagcacagcaactgaaggaaggcgttccccaacctgctgtcctatgaaggcctctaggtcaccggtgctaaagccctcctttctccaccctccttaagtggaggtaaacgtcccagcaggaagtcaaggctggattggcgctcttcgcgagcaccctgggaacgggagtctgggtcacgggtgctagagccctcccctctcctcccggccggtgtatgggaaattgtccccgcagaaagtaaaggctggccaggccgcccccagcacgtagagggaatgagtcaggctccggctccacactggcacgtagtgggcggatcgcgccggcgctgagtaggaaggagcttcagccgccagcccggaacgcatcataggttagcttttcaagacacttcctgcatctctgacctgttgcacctctgttatcttggcacctctgttatcttagcagcaagcacctgcctcagctgacccttgagccataacccatagggcttattccaaagggccagtgtgcaaaatatgaatccaagatggcattgtggaaagacgctgtacctcctgtgataaaattactttggtggtgcttttttctcatgtatctcgggaaactaaaaatctgaattgtattcagtggccttttccaaatgaagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatccattaggcctactggtggcagacccaggttggtgtggcttgctgccacaattccacccggaaaacatgaggattaaaaacagctccatatggccaaagaaccaa

SEQ ID NO: 361437 - DNA, 1094 bp, Homo sapiens
cacctcttgaaatacacaaaactcttctagtttcctggttgaccgacccagggcttgacgactccttttgagccacctgacaattcagtccagcacagcaactgaaggaaggcgttccccaacctgctgtcctatgaaggcctctaggtcaccggtgctaaagccctcctttctccaccctccttaagtggaggtaaacgtcccagcaggaagtcaaggctggattggcgctcttcgcgagcaccctgggaacgggagtctgggtcacgggtgctagagccctcccctctcctcccggccggtgtatgggaaattgtccccgcagaaagtaaaggctggccaggccgcccccagcacgtagagggaatgagtcaggctccggctccacactggcacgtagtgggcggatcgcgccggcgctgagtaggaaggagcttcagccgccagcccggaacgcatcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggtaattatttttccttgattgttaacgttatattatttttaaaaatgaagttccttttttggtcttttaaaagtatagctacaaaaataaatcatgttgatcttgatacctagtgaatagagcttaaaattagtcatttgacagtgctcataccagtttgtctgaaagtcagaataggagaaccattaaggttgtttcatggtaaagttagggagggtacagtcaggaaatctcttgggccattatatgaatggaagaaatttatagtcagttctactataacacctgttttgaaaacatgaatcttcaacatgattgatatattagagaacaatgtaagcataa

SEQ ID NO: 361438 - DNA, 795 bp, Homo sapiens
agttgaagttagaataaaaactaattctatttataaatgtattttctatatggaaataacatgtttcttctgtatattacatctacagggaacattgctgttgtcccaattatcaaaaccattggtttaggccttggaatcttaatctggggatcatttaatgccttaactggctgggcaagctcaaggtaattcaagtcaaactagttcaactaagatttcctgcatccatattctatgtaaagcaagtgattaccgagaggaataacatatgattcttattctcacagagtttatagctggtaaaacatacacatcatatatgccaccttctattgctatttgccctaaattcttaataagtgatctagatatttgatcaagatatagtgtagcattaaatctgggaaacagaggtagagagagaaaaaggaaactgatgtttattgtccctttctattgtgtgacaatttgctggacatgttctatgcatcattctcatctcactttcacaaatacgtgaggtaagcactatcttataagagagtagataaaaagagattaagtaacttactgtaggtcacagaactaagaagctaggattcaaacccaggtcttctagttccagagcacatattctttcctctagagcagggttggcaaagcacggtctggtttcccagccatttctataaataacgttttatcagaacacagccaaacccatccatttaaggattgtctatggctatttttatgttacagtggcagagttgagcagcaagggaataactg

SEQ ID NO: 361439 - DNA, 615 bp, Homo sapiens
ccaagaatccctccataatacagagcatgtgatcaacacaacccaagacccctgttcctgggtggataaactttctacagtacaccaccgcatagtgtaaggagaggttacttctttgctctattactctgtttcatatttggttaaagcagggattaccagcatgaagtaatgttcatctgagttcaagaagaaaattgtaatgcaagctttgacttctatctccatgcggcgaggtttttttgtccccagctgaattttaggtacagatgcccttgagctcaactgctttgagtaattactaaatcattgcatttatctccaaatgataagtagataataaaagcaacctaattttgcatgacttgtgtagctaaagtaaaagaggtagtaacgtgaccaacctgctctcagcagtcatagtcagattaggcaataaacttgtctagcactgcaccacccaggatgcccaccctgctctgggaatccccacactcctgtgtttagacagttatataattccagacattcattgtcaaatatagtggaacattctgtgtccgtgtgggtcctactccctctatctccgtggttgttctgttttttggacttcca

SEQ ID NO: 361440 - DNA, 428 bp, Homo sapiens
agcagtcctgtggtgaggcccatgtcaagaaggcctgagatctcccaccatcagctacagccaatttgtcagtcacgtgagtaaaccacctgggacgtgaatcctctcgacttaaccacctcttcaggtggccagagccctagcccaggtctgactgcaacctgatgagaaaccctgagtaggaagacctgcttgagctgctcccaaattattgatccacacacacacacacacacacagagtctctagtcttcctagctccttaatttttttttccttagcacatatcactatttcatataccatatttgtcatctattttctggtttccctttctcagatgtaagctaagttggtgcaggggtttttgtctgttcccaatgtctagaagagtgtctgatttacagtagacactccatgaaatttgt

SEQ ID NO: 361441 - DNA, 4426 bp, Homo sapiens
cacctcttgaaatacacaaaactcttctagtttcctggttgaccgacccagggcttgacgactccttttgagccacctgacaattcagtccagcacagcaactgaaggaaggcgttccccaacctgctgtcctatgaaggcctctaggtcaccggtgctaaagccctcctttctccaccctccttaagtggaggtaaacgtcccagcaggaagtcaaggctggattggcgctcttcgcgagcaccctgggaacgggagtctgggtcacgggtgctagagccctcccctctcctcccggccggtgtatgggaaattgtccccgcagaaagtaaaggctggccaggccgcccccagcacgtagagggaatgagtcaggctccggctccacactggcacgtagtgggcggatcgcgccggcgctgagtaggaaggagcttcagccgccagcccggaacgcagtgagtacagccactcaaaggaaagccaagtcgctttgcaggggagcgtctcatgatttttcagaaacgtgctcatggttaaaaagaaaaatcaaggctcggaataaatacattcaagcactgttaattttagcccaaagacaggcggtacttgcctggagatttgggaaaatcaacatgaaactaaaaatgaaattttagttggagtggagcaagcagtattgatcagaacataccaaatacgaattttttcaaagtctgcgtagaagtttaaattactaggaaaaatgtaaaggagaagtatttactaataaatgaaacaaaagtaataaaataaaaatgaattaatatagtttgacaaaatatcagcgaacgctgaaaagaaaacattaaaataatgtttgagactttttaggttttgtgcaggaagaattgggaaaaatgtgctggatggagtgatactgcttttcttttccacaaaaatttcattattttagagagcggtagagcctttttaaagacagtaagttattgccaattcacaatgaaataagatcacatgctctgaaatgtacaagagctgcatgcaataaacttcatttatctataggtaataactgattgatgtttattcagtagtcgaaatgcacctcatgcactctaattagcacgtcaaattagtctctccgtttcagaggtgtagggcctttgtggagccttctcaataaaataatttgccactcttgaaggttagacattctcttctatcaatgtacacataaaggttttgttttgctttgcttgttgtgaattaaaatggggagaaaatgatgtgttagctattacccagtcatgtgtctttttagtcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatattttgttcatcaaaagtgaaataccaaataacacgtgttccatggataccactccattaataacagagcatgtgagtgatcaacacaacccaagacccctgttcctgggtggataaactttctacagtacaccaccgcatagtgggctgcagtcttgcagtgatatctggagtactctatggatctacatttgtgccaatcatctacatcaaggaccacagcaaaagaaatgatagtatatatgcaggggcaagccaatatgatttagactatgtgtttgcgcacttcagtggcatctttcttacaagtactgtctactttctggcctactgcatagccatgaaaaatagtcctaaactatatcctgaagcagtcctaccaggattcctgtcaggagtactttgggctatagctacctgctgttggttcatagcaaatcactctctgagtgctgtggtcagttttccaataatcactgctggtccaggatttatagctgcaatgtggggtatcttcatgtttaaggaaataaagggtctacaaaactacctattaatgatacttgcattttgcatcatcttgactggagccttatgcactgctttttctaaaatctaacaatgacaaaaccagcaggtggcagcagtagttaagagaacgcgtctatcggacagcggagagatcatgctgagaaaagagtgcattttcatatagcaaatggatctcagccactgttggagtgggtaaatgatttttttccccaaaaatgtgagaatgaaggaagattgagtttcattcaagtataaaaatgaaaatttcttctgatgaactgtttatgaaggtagtactttactgggtgactaaaatgtctacattattatagcattacatacgaggatgctctttttaccacagtatgtacctagtgttgcataatctagaacacagtatagagtccatatacaaagaagttacagcccatatttctcacctattaccccagtgaagtgaggcagaaataccttgggcgaggagggagagccttaccttctaatggaattagattccaaagatatttggatcctttgtttcataaagtaaatgcatagttggtaactaaatgttaaaaaggccattttattattgttagccaaaacttctgtttatttcaagttaatatcgcccaactctacatcatctacccattttagctcataatgcttttgattatcgccagataaagtccattctcagagaacaaaaatttttcatcattgagaaaatgtgcataacataatacatacatacacaagtatattcacgtacataaatacacacagatatgttgctaaagtgagattgtaggttatcagtaacaatttaaaggaaacaaccactcttttgaatgtacaatttttttttctgaaatacacttttctaaaaccctcttaactggaggtttcctgttttcttcttgttttaactggtggtttccagtaggcaaaataaaatgacaggcatgctagttttttttttgttttttttttttaagaaaactgaaattaagccaggcagggtggcgcactactataatcccagctgctggggcggctgaagtaggagggtcacttagcccaagagtgcaaatctgccagcctaggcaacatagcaaggtcccatctctaaaaaagaaatttaatttaaatttgtaagaaaaaagaaaactgaaacagaactgccagtacaatgtttgttgcaattgtttccaaaactttgaaataacgaaacccctattcaaatgtaaattttacccattcccacctgatagtactgtttattactttgctatgcaggagaaacaaaacagctttttatttgtgtgtatactctgaagtcaatgtgcatgggttaaatcccacctctgcttcattttatttgtgtggctttggacaagttcctaagccctctgtgtcaggcccctcattaacaaaatggagtttatgatggcatctacctcacatggttattgtgtggttgaaattagttcaaatctgtaaagtatgttgatgagtatctggtacttggcaaacactatataattgttagctttattattatgtgttgtttgaaggggaaaaaagtttttgtagattggagaacaccatgtaagagctactaagctcaccaccttcccatccaattattactcctctaaatgaatactacttaaaagtgatggagcttctgtttgtttattgaattgctaatacaaataaatatttgactataacttcttatactcattttaattttaacctgaaatgtcattaaattatgctgataaactttgaataaattgtgatacaaaagctatttttctcatttaaatatattttagaattttatattggataacttttaattattctttagttgggatttccaatttatatgcaaaattttaaatgtgaagtaaagcagtttcagaagaaaaatg

SEQ ID NO: 361442 - DNA, 3244 bp, Homo sapiens
agcagtcctgtggtgaggcccatgtcaagaaggcctgagatctcccaccatcagctacagccaatttgtcagtcacagatcctcaaaatgagcagcagatacactcagtctgtaggatcatttagcaactcggggaaggaggtcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatattttgttcatcaaaagtgaaataccaaataacacgtgttccatggataccactccattaataacagagcatgtgagtgatcaacacaacccaagacccctgttcctgggtggataaactttctacagtacaccaccgcatagtgggctgcagtcttgcagtgatatctggagtactctatggatctacatttgtgccaatcatctacatcaaggaccacagcaaaagaaatgatagtatatatgcaggggcaagccaatatgatttagactatgtgtttgcgcacttcagtggcatctttcttacaagtactgtctactttctggcctactgcatagccatgaaaaatagtcctaaactatatcctgaagcagtcctaccaggattcctgtcaggagtactttgggctatagctacctgctgttggttcatagcaaatcactctctgagtgctgtggtcagttttccaataatcactgctggtccaggatttatagctgcaatgtggggtatcttcatgtttaaggaaataaagggtctacaaaactacctattaatgatacttgcattttgcatcatcttgactggagccttatgcactgctttttctaaaatctaacaatgacaaaaccagcaggtggcagcagtagttaagagaacgcgtctatcggacagcggagagatcatgctgagaaaagagtgcattttcatatagcaaatggatctcagccactgttggagtgggtaaatgatttttttccccaaaaatgtgagaatgaaggaagattgagtttcattcaagtataaaaatgaaaatttcttctgatgaactgtttatgaaggtagtactttactgggtgactaaaatgtctacattattatagcattacatacgaggatgctctttttaccacagtatgtacctagtgttgcataatctagaacacagtatagagtccatatacaaagaagttacagcccatatttctcacctattaccccagtgaagtgaggcagaaataccttgggcgaggagggagagccttaccttctaatggaattagattccaaagatatttggatcctttgtttcataaagtaaatgcatagttggtaactaaatgttaaaaaggccattttattattgttagccaaaacttctgtttatttcaagttaatatcgcccaactctacatcatctacccattttagctcataatgcttttgattatcgccagataaagtccattctcagagaacaaaaatttttcatcattgagaaaatgtgcataacataatacatacatacacaagtatattcacgtacataaatacacacagatatgttgctaaagtgagattgtaggttatcagtaacaatttaaaggaaacaaccactcttttgaatgtacaatttttttttctgaaatacacttttctaaaaccctcttaactggaggtttcctgttttcttcttgttttaactggtggtttccagtaggcaaaataaaatgacaggcatgctagttttttttttgttttttttttttaagaaaactgaaattaagccaggcagggtggcgcactactataatcccagctgctggggcggctgaagtaggagggtcacttagcccaagagtgcaaatctgccagcctaggcaacatagcaaggtcccatctctaaaaaagaaatttaatttaaatttgtaagaaaaaagaaaactgaaacagaactgccagtacaatgtttgttgcaattgtttccaaaactttgaaataacgaaacccctattcaaatgtaaattttacccattcccacctgatagtactgtttattactttgctatgcaggagaaacaaaacagctttttatttgtgtgtatactctgaagtcaatgtgcatgggttaaatcccacctctgcttcattttatttgtgtggctttggacaagttcctaagccctctgtgtcaggcccctcattaacaaaatggagtttatgatggcatctacctcacatggttattgtgtggttgaaattagttcaaatctgtaaagtatgttgatgagtatctggtacttggcaaacactatataattgttagctttattattatgtgttgtttgaaggggaaaaaagtttttgtagattggagaacaccatgtaagagctactaagctcaccaccttcccatccaattattactcctctaaatgaatactacttaaaagtgatggagcttctgtttgtttattgaattgctaatacaaataaatatttgactataacttcttatactcattttaattttaacctgaaatgtcattaaattatgctgataaactttgaataaattgtgatacaaaagctatttttctcatttaaatatattttagaattttatattggataacttttaattattctttagttgggatttccaatttatatgcaaaattttaaatgtgaagtaaagcagtttcagaagaaaaatg

SEQ ID NO: 361443 - DNA, 3404 bp, Homo sapiens
agcagtcctgtggtgaggcccatgtcaagaaggcctgagatctcccaccatcagctacagccaatttgtcagtcacagatcctcaaaatgagcagcagatacactcagtctgtaggatcatttagcaactcggggaaggaggtcataggttagcttttcaagacacttcctgcatctctgacctgttgcacctctgttatcttggcacctctgttatcttagcagcaagcacctgcctcagctgacccttgagccataacccatagggcttattccaaagggccagtgtgcaaaatatgaatccaagatggcattgtggaaagacgctgtacctcctgtgataaaattactttggtggtgcttttttctcatgtatctcgggaaactaaaaatctgaattgtattcagtggccttttccaaatgaagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatattttgttcatcaaaagtgaaataccaaataacacgtgttccatggataccactccattaataacagagcatgtgagtgatcaacacaacccaagacccctgttcctgggtggataaactttctacagtacaccaccgcatagtgggctgcagtcttgcagtgatatctggagtactctatggatctacatttgtgccaatcatctacatcaaggaccacagcaaaagaaatgatagtatatatgcaggggcaagccaatatgatttagactatgtgtttgcgcacttcagtggcatctttcttacaagtactgtctactttctggcctactgcatagccatgaaaaatagtcctaaactatatcctgaagcagtcctaccaggattcctgtcaggagtactttgggctatagctacctgctgttggttcatagcaaatcactctctgagtgctgtggtcagttttccaataatcactgctggtccaggatttatagctgcaatgtggggtatcttcatgtttaaggaaataaagggtctacaaaactacctattaatgatacttgcattttgcatcatcttgactggagccttatgcactgctttttctaaaatctaacaatgacaaaaccagcaggtggcagcagtagttaagagaacgcgtctatcggacagcggagagatcatgctgagaaaagagtgcattttcatatagcaaatggatctcagccactgttggagtgggtaaatgatttttttccccaaaaatgtgagaatgaaggaagattgagtttcattcaagtataaaaatgaaaatttcttctgatgaactgtttatgaaggtagtactttactgggtgactaaaatgtctacattattatagcattacatacgaggatgctctttttaccacagtatgtacctagtgttgcataatctagaacacagtatagagtccatatacaaagaagttacagcccatatttctcacctattaccccagtgaagtgaggcagaaataccttgggcgaggagggagagccttaccttctaatggaattagattccaaagatatttggatcctttgtttcataaagtaaatgcatagttggtaactaaatgttaaaaaggccattttattattgttagccaaaacttctgtttatttcaagttaatatcgcccaactctacatcatctacccattttagctcataatgcttttgattatcgccagataaagtccattctcagagaacaaaaatttttcatcattgagaaaatgtgcataacataatacatacatacacaagtatattcacgtacataaatacacacagatatgttgctaaagtgagattgtaggttatcagtaacaatttaaaggaaacaaccactcttttgaatgtacaatttttttttctgaaatacacttttctaaaaccctcttaactggaggtttcctgttttcttcttgttttaactggtggtttccagtaggcaaaataaaatgacaggcatgctagttttttttttgttttttttttttaagaaaactgaaattaagccaggcagggtggcgcactactataatcccagctgctggggcggctgaagtaggagggtcacttagcccaagagtgcaaatctgccagcctaggcaacatagcaaggtcccatctctaaaaaagaaatttaatttaaatttgtaagaaaaaagaaaactgaaacagaactgccagtacaatgtttgttgcaattgtttccaaaactttgaaataacgaaacccctattcaaatgtaaattttacccattcccacctgatagtactgtttattactttgctatgcaggagaaacaaaacagctttttatttgtgtgtatactctgaagtcaatgtgcatgggttaaatcccacctctgcttcattttatttgtgtggctttggacaagttcctaagccctctgtgtcaggcccctcattaacaaaatggagtttatgatggcatctacctcacatggttattgtgtggttgaaattagttcaaatctgtaaagtatgttgatgagtatctggtacttggcaaacactatataattgttagctttattattatgtgttgtttgaaggggaaaaaagtttttgtagattggagaacaccatgtaagagctactaagctcaccaccttcccatccaattattactcctctaaatgaatactacttaaaagtgatggagcttctgtttgtttattgaattgctaatacaaataaatatttgactataacttcttatactcattttaattttaacctgaaatgtcattaaattatgctgataaactttgaataaattgtgatacaaaagctatttttctcatttaaatatattttagaattttatattggataacttttaattattctttagttgggatttccaatttatatgcaaaattttaaatgtgaagtaaagcagtttcagaagaaaaatg

SEQ ID NO: 361444 - DNA, 3028 bp, Homo sapiens
aggatcacgacggcgggtgtactattcagtggcttttccagatgaaggaagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatattttgttcatcaaaagtgaaataccaaataacacgtgttccatggataccactccattaataacagagcatgtgagtgatcaacacaacccaagacccctgttcctgggtggataaactttctacagtacaccaccgcatagtgggctgcagtcttgcagtgatatctggagtactctatggatctacatttgtgccaatcatctacatcaaggaccacagcaaaagaaatgatagtatatatgcaggggcaagccaatatgatttagactatgtgtttgcgcacttcagtggcatctttcttacaagtactgtctactttctggcctactgcatagccatgaaaaatagtcctaaactatatcctgaagcagtcctaccaggattcctgtcaggagtactttgggctatagctacctgctgttggttcatagcaaatcactctctgagtgctgtggtcagttttccaataatcactgctggtccaggatttatagctgcaatgtggggtatcttcatgtttaaggaaataaagggtctacaaaactacctattaatgatacttgcattttgcatcatcttgactggagccttatgcactgctttttctaaaatctaacaatgacaaaaccagcaggtggcagcagtagttaagagaacgcgtctatcggacagcggagagatcatgctgagaaaagagtgcattttcatatagcaaatggatctcagccactgttggagtgggtaaatgatttttttccccaaaaatgtgagaatgaaggaagattgagtttcattcaagtataaaaatgaaaatttcttctgatgaactgtttatgaaggtagtactttactgggtgactaaaatgtctacattattatagcattacatacgaggatgctctttttaccacagtatgtacctagtgttgcataatctagaacacagtatagagtccatatacaaagaagttacagcccatatttctcacctattaccccagtgaagtgaggcagaaataccttgggcgaggagggagagccttaccttctaatggaattagattccaaagatatttggatcctttgtttcataaagtaaatgcatagttggtaactaaatgttaaaaaggccattttattattgttagccaaaacttctgtttatttcaagttaatatcgcccaactctacatcatctacccattttagctcataatgcttttgattatcgccagataaagtccattctcagagaacaaaaatttttcatcattgagaaaatgtgcataacataatacatacatacacaagtatattcacgtacataaatacacacagatatgttgctaaagtgagattgtaggttatcagtaacaatttaaaggaaacaaccactcttttgaatgtacaatttttttttctgaaatacacttttctaaaaccctcttaactggaggtttcctgttttcttcttgttttaactggtggtttccagtaggcaaaataaaatgacaggcatgctagttttttttttgttttttttttttaagaaaactgaaattaagccaggcagggtggcgcactactataatcccagctgctggggcggctgaagtaggagggtcacttagcccaagagtgcaaatctgccagcctaggcaacatagcaaggtcccatctctaaaaaagaaatttaatttaaatttgtaagaaaaaagaaaactgaaacagaactgccagtacaatgtttgttgcaattgtttccaaaactttgaaataacgaaacccctattcaaatgtaaattttacccattcccacctgatagtactgtttattactttgctatgcaggagaaacaaaacagctttttatttgtgtgtatactctgaagtcaatgtgcatgggttaaatcccacctctgcttcattttatttgtgtggctttggacaagttcctaagccctctgtgtcaggcccctcattaacaaaatggagtttatgatggcatctacctcacatggttattgtgtggttgaaattagttcaaatctgtaaagtatgttgatgagtatctggtacttggcaaacactatataattgttagctttattattatgtgttgtttgaaggggaaaaaagtttttgtagattggagaacaccatgtaagagctactaagctcaccaccttcccatccaattattactcctctaaatgaatactacttaaaagtgatggagcttctgtttgtttattgaattgctaatacaaataaatatttgactataacttcttatactcattttaattttaacctgaaatgtcattaaattatgctgataaactttgaataaattgtgatacaaaagctatttttctcatttaaatatattttagaattttatattggataacttttaattattctttagttgggatttccaatttatatgcaaaattttaaatgtgaagtaaagcagtttcagaagaaaaatg

SEQ ID NO: 361445 - DNA, 2776 bp, Homo sapiens
agttgaagttagaataaaaactaattctatttataaatgtattttctatatggaaataacatgtttcttctgtatattacatctacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatattttgttcatcaaaagtgaaataccaaataacacgtgttccatggataccactccattaataacagagcatgtgagtgatcaacacaacccaagacccctgttcctgggtggataaactttctacagtacaccaccgcatagtgggctgcagtcttgcagtgatatctggagtactctatggatctacatttgtgccaatcatctacatcaaggaccacagcaaaagaaatgatagtatatatgcaggggcaagccaatatgatttagactatgtgtttgcgcacttcagtggcatctttcttacaagtactgtctactttctggcctactgcatagccatgaaaaatagtcctaaactatatcctgaagcagtcctaccaggattcctgtcaggagtactttgggctatagctacctgctgttggttcatagcaaatcactctctgagtgctgtggtcagttttccaataatcactgctggtccaggatttatagctgcaatgtggggtatcttcatgtttaaggaaataaagggtctacaaaactacctattaatgatacttgcattttgcatcatcttgactggagccttatgcactgctttttctaaaatctaacaatgacaaaaccagcaggtggcagcagtagttaagagaacgcgtctatcggacagcggagagatcatgctgagaaaagagtgcattttcatatagcaaatggatctcagccactgttggagtgggtaaatgatttttttccccaaaaatgtgagaatgaaggaagattgagtttcattcaagtataaaaatgaaaatttcttctgatgaactgtttatgaaggtagtactttactgggtgactaaaatgtctacattattatagcattacatacgaggatgctctttttaccacagtatgtacctagtgttgcataatctagaacacagtatagagtccatatacaaagaagttacagcccatatttctcacctattaccccagtgaagtgaggcagaaataccttgggcgaggagggagagccttaccttctaatggaattagattccaaagatatttggatcctttgtttcataaagtaaatgcatagttggtaactaaatgttaaaaaggccattttattattgttagccaaaacttctgtttatttcaagttaatatcgcccaactctacatcatctacccattttagctcataatgcttttgattatcgccagataaagtccattctcagagaacaaaaatttttcatcattgagaaaatgtgcataacataatacatacatacacaagtatattcacgtacataaatacacacagatatgttgctaaagtgagattgtaggttatcagtaacaatttaaaggaaacaaccactcttttgaatgtacaatttttttttctgaaatacacttttctaaaaccctcttaactggaggtttcctgttttcttcttgttttaactggtggtttccagtaggcaaaataaaatgacaggcatgctagttttttttttgttttttttttttaagaaaactgaaattaagccaggcagggtggcgcactactataatcccagctgctggggcggctgaagtaggagggtcacttagcccaagagtgcaaatctgccagcctaggcaacatagcaaggtcccatctctaaaaaagaaatttaatttaaatttgtaagaaaaaagaaaactgaaacagaactgccagtacaatgtttgttgcaattgtttccaaaactttgaaataacgaaacccctattcaaatgtaaattttacccattcccacctgatagtactgtttattactttgctatgcaggagaaacaaaacagctttttatttgtgtgtatactctgaagtcaatgtgcatgggttaaatcccacctctgcttcattttatttgtgtggctttggacaagttcctaagccctctgtgtcaggcccctcattaacaaaatggagtttatgatggcatctacctcacatggttattgtgtggttgaaattagttcaaatctgtaaagtatgttgatgagtatctggtacttggcaaacactatataattgttagctttattattatgtgttgtttgaaggggaaaaaagtttttgtagattggagaacaccatgtaagagctactaagctcaccaccttcccatccaattattactcctctaaatgaatactacttaaaagtgatggagcttctgtttgtttattgaattgctaatacaaataaatatttgactataacttcttatactcattttaattttaacctgaaatgtcattaaattatgctgataaactttgaataaattgtgatacaaaagctatttttctcatttaaatatattttagaattttatattggataacttttaattattctttagttgggatttccaatttatatgcaaaattttaaatgtgaagtaaagcagtttcagaagaaaaatg

SEQ ID NO: 361446 - DNA, 1813 bp, Homo sapiens
  misc_feature (1813)..(1813): n is a, c, g, or t
cacctcttgaaatacacaaaactcttctagtttcctggttgaccgacccagggcttgacgactccttttgagccacctgacaattcagtccagcacagcaactgaaggaaggcgttccccaacctgctgtcctatgaaggcctctaggtcaccggtgctaaagccctcctttctccaccctccttaagtggaggtaaacgtcccagcaggaagtcaaggctggattggcgctcttcgcgagcaccctgggaacgggagtctgggtcacgggtgctagagccctcccctctcctcccggccggtgtatgggaaattgtccccgcagaaagtaaaggctggccaggccgcccccagcacgtagagggaatgagtcaggctccggctccacactggcacgtagtgggcggatcgcgccggcgctgagtaggaaggagcttcagccgccagcccggaacgcatcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatattttgttcatcaaaagtgaaataccaaataacacgtgttccatggataccactccattaataacagagcatgtgagggctgcagtcttgcagtgatatctggagtactctatggatctacatttgtgccaatcatctacatcaaggaccacagcaaaagaaatgatagtatatatgcaggggcaagccaatatgatttagactatgtgtttgcgcacttcagtggcatctttcttacaagtactgtctactttctggcctactgcatagccatgaaaaatagtcctaaactatatcctgaagcagtcctaccaggattcctgtcaggagtactttgggctatagctacctgctgttggttcatagcaaatcactctctgagtgctgtggtcagttttccaataatcactgctgatccatgagttatagctgttatgcgagcgatctcatcgcattatgaccacttgcatgcacaactctgtgcccactttccatacgcgaggggaggtggaacctttgccgaagataagcggtggctggaactttataaaccaccaccgcttatactgcctgactgttgcagactataaccgaccatctcgaccagtctatggcctacaggtaattttaattaaacacctatgggccacagagtaagtcttttctaaccccatcctttagaggagcccacttgaaagagtttggcccacacacttaggtttgattacgagtcttgttccaggtaaggggn

SEQ ID NO: 361447 - DNA, 2445 bp, Homo sapiens
cacctcttgaaatacacaaaactcttctagtttcctggttgaccgacccagggcttgacgactccttttgagccacctgacaattcagtccagcacagcaactgaaggaaggcgttccccaacctgctgtcctatgaaggcctctaggtcaccggtgctaaagccctcctttctccaccctccttaagtggaggtaaacgtcccagcaggaagtcaaggctggattggcgctcttcgcgagcaccctgggaacgggagtctgggtcacgggtgctagagccctcccctctcctcccggccggtgtatgggaaattgtccccgcagaaagtaaaggctggccaggccgcccccagcacgtagagggaatgagtcaggctccggctccacactggcacgtagtgggcggatcgcgccggcgctgagtaggaaggagcttcagccgccagcccggaacgcagtgagtacagccactcaaaggaaagccaagtcgctttgcaggggagcgtctcatgatttttcagaaacgtgctcatggttaaaaagaaaaatcaaggctcggaataaatacattcaagcactgttaattttagcccaaagacaggcggtacttgcctggagatttgggaaaatcaacatgaaactaaaaatgaaattttagttggagtggagcaagcagtattgatcagaacataccaaatacgaattttttcaaagtctgcgtagaagtttaaattactaggaaaaatgtaaaggagaagtatttactaataaatgaaacaaaagtaataaaataaaaatgaattaatatagtttgacaaaatatcagcgaacgctgaaaagaaaacattaaaataatgtttgagactttttaggttttgtgcaggaagaattgggaaaaatgtgctggatggagtgatactgcttttcttttccacaaaaatttcattattttagagagcggtagagcctttttaaagacagtaagttattgccaattcacaatgaaataagatcacatgctctgaaatgtacaagagctgcatgcaataaacttcatttatctataggtaataactgattgatgtttattcagtagtcgaaatgcacctcatgcactctaattagcacgtcaaattagtctctccgtttcagaggtgtagggcctttgtggagccttctcaataaaataatttgccactcttgaaggttagacattctcttctatcaatgtacacataaaggttttgttttgctttgcttgttgtgaattaaaatggggagaaaatgatgtgttagctattacccagtcatgtgtctttttagtcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtaattcaagtcaaactagttcaactaagatttcctgcatccatattctatgtaaagcaagtgattaccgagaggaataacatatgattcttattctcacagagtttatagctggtaaaacatacacatcatatatgccaccttctattgctatttgccctaaattcttaataagtgatctagatatttgatcaagatatagtgtagcattaaatctgggaaacagaggtagagagagaaaaaggaaactgatgtttattgtccctttctattgtgtgacaatttgctggacatgttctatgcatcattctcatctcactttcacaaatacgtgaggtaagcactatcttataagagagtagataaaaagagattaagtaacttactgtaggtcacagaactaagaagctaggattcaaacccaggtcttctagttccagagcacatattctttcctctagagcagggttggcaaagcacggtctggtttcccagccatttctataaataacgttttatcagaacacagccaaacccatccatttaaggattgtctatggctatttttatgttacagtggcagagttgagcagcaagggaataactg

SEQ ID NO: 361448 - DNA, 1769 bp, Homo sapiens
cacctcttgaaatacacaaaactcttctagtttcctggttgaccgacccagggcttgacgactccttttgagccacctgacaattcagtccagcacagcaactgaaggaaggcgttccccaacctgctgtcctatgaaggcctctaggtcaccggtgctaaagccctcctttctccaccctccttaagtggaggtaaacgtcccagcaggaagtcaaggctggattggcgctcttcgcgagcaccctgggaacgggagtctgggtcacgggtgctagagccctcccctctcctcccggccggtgtatgggaaattgtccccgcagaaagtaaaggctggccaggccgcccccagcacgtagagggaatgagtcaggctccggctccacactggcacgtagtgggcggatcgcgccggcgctgagtaggaaggagcttcagccgccagcccggaacgcagtgagtacagccactcaaaggaaagccaagtcgctttgcaggggagcgtctcatgatttttcagaaacgtgctcatggttaaaaagaaaaatcaaggctcggaataaatacattcaagcactgttaattttagcccaaagacaggcggtacttgcctggagatttgggaaaatcaacatgaaactaaaaatgaaattttagttggagtggagcaagcagtattgatcagaacataccaaatacgaattttttcaaagtctgcgtagaagtttaaattactaggaaaaatgtaaaggagaagtatttactaataaatgaaacaaaagtaataaaataaaaatgaattaatatagtttgacaaaatatcagcgaacgctgaaaagaaaacattaaaataatgtttgagactttttaggttttgtgcaggaagaattgggaaaaatgtgctggatggagtgatactgcttttcttttccacaaaaatttcattattttagagagcggtagagcctttttaaagacagtaagttattgccaattcacaatgaaataagatcacatgctctgaaatgtacaagagctgcatgcaataaacttcatttatctataggtaataactgattgatgtttattcagtagtcgaaatgcacctcatgcactctaattagcacgtcaaattagtctctccgtttcagaggtgtagggcctttgtggagccttctcaataaaataatttgccactcttgaaggttagacattctcttctatcaatgtacacataaaggttttgttttgctttgcttgttgtgaattaaaatggggagaaaatgatgtgttagctattacccagtcatgtgtctttttagtcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacaggaacatgtggggcccaatatccatgtgcctg

SEQ ID NO: 361449 - DNA, 524 bp, Homo sapiens
ttatcttagcagcaagcacctgcctcagctgacccttgagccataacccatgtaagtcactgcagggctgaacctctctttgagcctaacagtagaataataattatttttattgaatagtgttaatgtgtcaatgttgaaatgtgcctcagtgtgtcttcctcaaccacatccctatagaggatgttttcttaatagcaatgtgtttttgttttaagaaagtccacacaatttcaaatacacattttctttactaaagtttattgaccagttttgaagtgatccttgttttcagttaaactatctttaataatggtaaataacatattttgtaggttgttgtatatttaatattctctgcaagaacacataaggaacaatacatggacctttaaatatttgtcattgtgaaataaaataacaaggaaaggtgatttcaggtgtactttattcaatacatatatacaagaagttattactataacattaaatttgcaggaaaaaagaaaccactggattattct

SEQ ID NO: 361450 - DNA, 1273 bp, Homo sapiens
  misc_feature (1161)..(1161): n is a, c, g, or t
cacctcttgaaatacacaaaactcttctagtttcctggttgaccgacccagggcttgacgactccttttgagccacctgacaattcagtccagcacagcaactgaaggaaggcgttccccaacctgctgtcctatgaaggcctctaggtcaccggtgctaaagccctcctttctccaccctccttaagtggaggtaaacgtcccagcaggaagtcaaggctggattggcgctcttcgcgagcaccctgggaacgggagtctgggtcacgggtgctagagccctcccctctcctcccggccggtgtatgggaaattgtccccgcagaaagtaaaggctggccaggccgcccccagcacgtagagggaatgagtcaggctccggctccacactggcacgtagtgggcggatcgcgccggcgctgagtaggaaggagcttcagccgccagcccggaacgcatcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatattttgttcatcaaaagtgaaataccaaataacacgtgttccatggataccactccattaataacagagcatgtgatcaacaacaaccaagaaccctgnccggggtgtgaaacacttctacaagaagacacacggaaaagaggtcgcaagcttagcgagaaaacagggaaacaccatagaaacacacttgagcacaccaccaagaaggacc

SEQ ID NO: 361451 - DNA, 3560 bp, Homo sapiens
cacctcttgaaatacacaaaactcttctagtttcctggttgaccgacccagggcttgacgactccttttgagccacctgacaattcagtccagcacagcaactgaaggaaggcgttccccaacctgctgtcctatgaaggcctctaggtcaccggtgctaaagccctcctttctccaccctccttaagtggaggtaaacgtcccagcaggaagtcaaggctggattggcgctcttcgcgagcaccctgggaacgggagtctgggtcacgggtgctagagccctcccctctcctcccggccggtgtatgggaaattgtccccgcagaaagtaaaggctggccaggccgcccccagcacgtagagggaatgagtcaggctccggctccacactggcacgtagtgggcggatcgcgccggcgctgagtaggaaggagcttcagccgccagcccggaacgcatcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatattttgttcatcaaaagtgaaataccaaataacacgtgttccatggataccactccattaataacagagcatgtgagtgatcaacacaacccaagacccctgttcctgggtggataaactttctacagtacaccaccgcatagtgggctgcagtcttgcagtgatatctggagtactctatggatctacatttgtgccaatcatctacatcaaggaccacagcaaaagaaatgatagtatatatgcaggggcaagccaatatgatttagactatgtgtttgcgcacttcagtggcatctttcttacaagtactgtctactttctggcctactgcatagccatgaaaaatagtcctaaactatatcctgaagcagtcctaccaggattcctgtcaggagtactttgggctatagctacctgctgttggttcatagcaaatcactctctgagtgctgtggtcagttttccaataatcactgctggtccaggatttatagctgcaatgtggggtatcttcatgtttaaggaaataaagggtctacaaaactacctattaatgatacttgcattttgcatcatcttgactggagccttatgcactgctttttctaaaatctaacaatgacaaaaccagcaggtggcagcagtagttaagagaacgcgtctatcggacagcggagagatcatgctgagaaaagagtgcattttcatatagcaaatggatctcagccactgttggagtgggtaaatgatttttttccccaaaaatgtgagaatgaaggaagattgagtttcattcaagtataaaaatgaaaatttcttctgatgaactgtttatgaaggtagtactttactgggtgactaaaatgtctacattattatagcattacatacgaggatgctctttttaccacagtatgtacctagtgttgcataatctagaacacagtatagagtccatatacaaagaagttacagcccatatttctcacctattaccccagtgaagtgaggcagaaataccttgggcgaggagggagagccttaccttctaatggaattagattccaaagatatttggatcctttgtttcataaagtaaatgcatagttggtaactaaatgttaaaaaggccattttattattgttagccaaaacttctgtttatttcaagttaatatcgcccaactctacatcatctacccattttagctcataatgcttttgattatcgccagataaagtccattctcagagaacaaaaatttttcatcattgagaaaatgtgcataacataatacatacatacacaagtatattcacgtacataaatacacacagatatgttgctaaagtgagattgtaggttatcagtaacaatttaaaggaaacaaccactcttttgaatgtacaatttttttttctgaaatacacttttctaaaaccctcttaactggaggtttcctgttttcttcttgttttaactggtggtttccagtaggcaaaataaaatgacaggcatgctagttttttttttgttttttttttttaagaaaactgaaattaagccaggcagggtggcgcactactataatcccagctgctggggcggctgaagtaggagggtcacttagcccaagagtgcaaatctgccagcctaggcaacatagcaaggtcccatctctaaaaaagaaatttaatttaaatttgtaagaaaaaagaaaactgaaacagaactgccagtacaatgtttgttgcaattgtttccaaaactttgaaataacgaaacccctattcaaatgtaaattttacccattcccacctgatagtactgtttattactttgctatgcaggagaaacaaaacagctttttatttgtgtgtatactctgaagtcaatgtgcatgggttaaatcccacctctgcttcattttatttgtgtggctttggacaagttcctaagccctctgtgtcaggcccctcattaacaaaatggagtttatgatggcatctacctcacatggttattgtgtggttgaaattagttcaaatctgtaaagtatgttgatgagtatctggtacttggcaaacactatataattgttagctttattattatgtgttgtttgaaggggaaaaaagtttttgtagattggagaacaccatgtaagagctactaagctcaccaccttcccatccaattattactcctctaaatgaatactacttaaaagtgatggagcttctgtttgtttattgaattgctaatacaaataaatatttgactataacttcttatactcattttaattttaacctgaaatgtcattaaattatgctgataaactttgaataaattgtgatacaaaagctatttttctcatttaaatatattttagaattttatattggataacttttaattattctttagttgggatttccaatttatatgcaaaattttaaatgtgaagtaaagcagtttcagaagaaaaatg

SEQ ID NO: 361452 - DNA, 3720 bp, Homo sapiens
cacctcttgaaatacacaaaactcttctagtttcctggttgaccgacccagggcttgacgactccttttgagccacctgacaattcagtccagcacagcaactgaaggaaggcgttccccaacctgctgtcctatgaaggcctctaggtcaccggtgctaaagccctcctttctccaccctccttaagtggaggtaaacgtcccagcaggaagtcaaggctggattggcgctcttcgcgagcaccctgggaacgggagtctgggtcacgggtgctagagccctcccctctcctcccggccggtgtatgggaaattgtccccgcagaaagtaaaggctggccaggccgcccccagcacgtagagggaatgagtcaggctccggctccacactggcacgtagtgggcggatcgcgccggcgctgagtaggaaggagcttcagccgccagcccggaacgcatcataggttagcttttcaagacacttcctgcatctctgacctgttgcacctctgttatcttggcacctctgttatcttagcagcaagcacctgcctcagctgacccttgagccataacccatagggcttattccaaagggccagtgtgcaaaatatgaatccaagatggcattgtggaaagacgctgtacctcctgtgataaaattactttggtggtgcttttttctcatgtatctcgggaaactaaaaatctgaattgtattcagtggccttttccaaatgaagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatattttgttcatcaaaagtgaaataccaaataacacgtgttccatggataccactccattaataacagagcatgtgagtgatcaacacaacccaagacccctgttcctgggtggataaactttctacagtacaccaccgcatagtgggctgcagtcttgcagtgatatctggagtactctatggatctacatttgtgccaatcatctacatcaaggaccacagcaaaagaaatgatagtatatatgcaggggcaagccaatatgatttagactatgtgtttgcgcacttcagtggcatctttcttacaagtactgtctactttctggcctactgcatagccatgaaaaatagtcctaaactatatcctgaagcagtcctaccaggattcctgtcaggagtactttgggctatagctacctgctgttggttcatagcaaatcactctctgagtgctgtggtcagttttccaataatcactgctggtccaggatttatagctgcaatgtggggtatcttcatgtttaaggaaataaagggtctacaaaactacctattaatgatacttgcattttgcatcatcttgactggagccttatgcactgctttttctaaaatctaacaatgacaaaaccagcaggtggcagcagtagttaagagaacgcgtctatcggacagcggagagatcatgctgagaaaagagtgcattttcatatagcaaatggatctcagccactgttggagtgggtaaatgatttttttccccaaaaatgtgagaatgaaggaagattgagtttcattcaagtataaaaatgaaaatttcttctgatgaactgtttatgaaggtagtactttactgggtgactaaaatgtctacattattatagcattacatacgaggatgctctttttaccacagtatgtacctagtgttgcataatctagaacacagtatagagtccatatacaaagaagttacagcccatatttctcacctattaccccagtgaagtgaggcagaaataccttgggcgaggagggagagccttaccttctaatggaattagattccaaagatatttggatcctttgtttcataaagtaaatgcatagttggtaactaaatgttaaaaaggccattttattattgttagccaaaacttctgtttatttcaagttaatatcgcccaactctacatcatctacccattttagctcataatgcttttgattatcgccagataaagtccattctcagagaacaaaaatttttcatcattgagaaaatgtgcataacataatacatacatacacaagtatattcacgtacataaatacacacagatatgttgctaaagtgagattgtaggttatcagtaacaatttaaaggaaacaaccactcttttgaatgtacaatttttttttctgaaatacacttttctaaaaccctcttaactggaggtttcctgttttcttcttgttttaactggtggtttccagtaggcaaaataaaatgacaggcatgctagttttttttttgttttttttttttaagaaaactgaaattaagccaggcagggtggcgcactactataatcccagctgctggggcggctgaagtaggagggtcacttagcccaagagtgcaaatctgccagcctaggcaacatagcaaggtcccatctctaaaaaagaaatttaatttaaatttgtaagaaaaaagaaaactgaaacagaactgccagtacaatgtttgttgcaattgtttccaaaactttgaaataacgaaacccctattcaaatgtaaattttacccattcccacctgatagtactgtttattactttgctatgcaggagaaacaaaacagctttttatttgtgtgtatactctgaagtcaatgtgcatgggttaaatcccacctctgcttcattttatttgtgtggctttggacaagttcctaagccctctgtgtcaggcccctcattaacaaaatggagtttatgatggcatctacctcacatggttattgtgtggttgaaattagttcaaatctgtaaagtatgttgatgagtatctggtacttggcaaacactatataattgttagctttattattatgtgttgtttgaaggggaaaaaagtttttgtagattggagaacaccatgtaagagctactaagctcaccaccttcccatccaattattactcctctaaatgaatactacttaaaagtgatggagcttctgtttgtttattgaattgctaatacaaataaatatttgactataacttcttatactcattttaattttaacctgaaatgtcattaaattatgctgataaactttgaataaattgtgatacaaaagctatttttctcatttaaatatattttagaattttatattggataacttttaattattctttagttgggatttccaatttatatgcaaaattttaaatgtgaagtaaagcagtttcagaagaaaaatg

SEQ ID NO: 361453 - DNA, 5682 bp, Homo sapiens
tgccacaattccctgagatctcccaggtggcagctgcctccccaagacaggctcactcaccatgaccaagctgagcgcccaagtcaaaggctctctcaacatcaccaccccggggctgcagatatggaggatcgaggccatgcagatggtgcctgttccttccagcacctttggaagcttcttcgatggtgactgctacatcatcctggctatccacaagacagccagcagcctgtcctatgacatccactactggattggccaggactcatccctggatgagcagggggcagctgccatctacaccacacagatggatgacttcctgaagggccgggctgtgcagcaccgcgaggtccagggcaacgagagcgaggccttccgaggctacttcaagcaaggccttgtgatccggaaagggggcgtggcttctggcatgaagcacgtggagaccaactcctatgacgtccagaggctgctgcatgtcaagggcaagaggaacgtggtagctggagaggtagagatgtcctggaagagtttcaaccgaggggatgttttcctcctggaccttgggaagcttatcatccagtggaatggaccggaaagcacccgtatggagagactcaggggcatgactctggccaaggagatccgagaccaggagcggggagggcgcacctatgtaggcgtggtggacggagagaatgaattggcatccccgaagctgatggaggtgatgaaccacgtgctgggcaagcgcagggagctgaaggcggccgtgcccgacacggtggtggagccggcactcaaggctgcactcaaactgtaccatgtgtctgactccgaggggaatctggtggtgagggaagtcgccacacggccactgacacaggacctgctcagtcacgaggactgttacatcctggaccaggggggcctgaagatctacgtgtggaaagggaagaaagccaatgagcaggagaagaagggagccatgagccatgcgctgaacttcatcaaagccaagcagtacccaccaagcacacaggtggaggtgcagaatgatggggctgagtcggccgtctttcagcagctcttccagaagtggacagcgtccaaccggacctcaggcctaggcaaaacccacactgtgggctccgtggccaaagtggaacaggtgaagttcgatgccacatccatgcatgtcaagcctcaggtggctgcccagcagaagatggtagatgatgggagtggggaagtgcaggtgtggcgcattgagaacctagagctggtacctgtggattccaagtggctaggccacttctatgggggcgactgctacctgctgctctacacctacctcatcggcgagaagcagcattacctgctctacgtttggcagggcagccaggccagccaagatgaaattacagcatcagcttatcaagccgtcatcctggaccagaagtacaatggtgaaccagtccagatccgggtcccaatgggcaaggagccacctcatcttatgtccatcttcaagggacgcatggtggtctaccagggaggcacctcccgaactaacaacttggagaccgggccctccacacggctgttccaggtccagggaactggcgccaacaacaccaaggcctttgaggtcccagcgcgggccaatttcctcaattccaatgatgtctttgtcctcaagacccagtcttgctgctatctatggtgtgggaagggttgtagcggggacgagcgggagatggccaagatggttgctgacaccatctcccggacggagaagcaagtggtggtggaagggcaggagccagccaacttctggatggccctgggtgggaaggccccctatgccaacaccaagagactacaggaagaaaacctggtcatcaccccccggctctttgagtgttccaacaagactgggcgcttcctggccacagagatccctgacttcaatcaggatgacttggaagaggatgatgtgttcctactagatgtctgggaccaggtcttcttctggattgggaaacatgccaacgaggaggagaagaaggccgcagcaaccactgcacaggaatacctcaagacccatcccagcgggcgtgaccctgagacccccatcattgtggtgaagcagggacacgagccccccaccttcacaggctggttcctggcttgggatcccttcaagtggagtaacaccaaatcctatgaggacctgaaggcggagcttggcaactctagggactggagccagatcactgctgaggtcacaagccccaaagtggacgtgttcaatgctaacagcaacctcagttctgggcctctgcccatcttccccctggagcagctagtgaacaagcctgtagaggagctccccgagggtgtggaccccagcaggaaggaggaacacctgtccattgaagatttcactcaggcctttgggatgactccagctgccttctctgctctgcctcgatggaagcaacaaaacctcaagaaagaaaaaggactattttgagaagagtagctgtggttgtaaagcagtaccctaccctgattgtagggtctcattttctcaccgatattagtcctacaccaattgaagtgaaattttgcagatgtgcctatgagcacaaacttctgtggcaaatgccagttttgtttaataatgtacctattccttcagaaagatgataccccaaaaggagcctatggtcctcatttcaacttctaaggtcgctagattgtttctatcctgaggtattgcatcaattttaatactcctatagttttctcttcttagaagagcacaaacactccatggaacattagagttctgaggcactaccctagcttgtcctctatcatgactcatttttatctatggcaggtaggctgaagcactttgcaggtttacatcttccccagagtaacagcttttccttttcacatatactttccttactgccttactcagtgggtaagttaaagggctgaaggagagttgaatggtccacaagactaccctcttaagaggtttcacaaattccaaacagtaccagtgagagcagcacttccactggggctaggcttgagacctaaaggcaagtatgaaatgcatatgctacttcactccctctcccaacccttaataatgaggcaaagcaagagcctagtgaaggccaatgctaggtttacaaacttacccagaagcctctgcaaagcttcacaggctcctcagatgaaaataacaggaatcaatggggactacggccagacactggtttgccattctgttccttttaagaagtaacagtgctgcaaggaagtccatgtcagaaagccaacagaaggtgatttccacaactttgaacaggttgttacaagtatcagcaagaatgtgtccttttcagaaataacagtcaaatcaaagaaggttaataaaggctttaatttcatacacacaaaaaaactctatgcataatttaaaaaggaaacaaaaacaaagaaaaaccgtaaaggatacagaggaacagttctgctaaaacacagataaaagtgccgctccatacaaaacataaagaatcagaatcaaaagtcactctgaacataaagaaaaaaaatcatctcacaaataatgtggccacagctgccagaaaacctggtagtggctcaattaggcaaagtgtaggaatctcatttttgtttttctctccttaagtttaaagaaacaacaatgacaataggccagagaagttagggagggaaagaaaagctcaaagggagggaaacctggggacaagaggtgtgcacacccacatgtggtctcactcttcacacaggcccactatttttgaagtagaccagtttagttgactgttcttctttgttctggcatctgactggaccaacctggaacctggtccagaccctcacccactctattcttatgccaatggacatacctatactttgaacctctgtacttttaagaaaagtccaatgttacaaaatcaaatgcttatattcagactggcacactttttaaataaaaactccatacacctcagacatatagcacacatggagacaacttactaattgtgtgtaagtatgatacaatgaatgagactgcctgaagtctagtaatcaaagcatgccataaggtgaatgattgtggttaaacacagcaaaataattgtcacaaaactttcaaggcctaacaaattagaattttccaataaaaaatatatattttttcagatgttaataagacatatcagtagagacaaaattaggattttgaagtaatgcaataaaaagatgttggagggcagaagtctatttagtttttgtatacacttgcaagagtgcattactcagtataaagcaaaatggggaggaaaaagacatccatccattttattggaacacttttatgtgacttgaatctggtgttaggttgttgatttttctaaaaatctcctatatatacaaaatccatatgtacttggagatccagctgttgccccctgtttaaaacaaaagaccacctcggggggtcaattaaattaaaaaggccctccaaccaccctaaatgggataactaagagtatctactgcagtcatttcagaggacagagaaggaaaatattttaatttgctttaatataacctcttttcagtagatcacaaatgagtttacaaactacttttttttctctttaatttaggtgtttgcagataattttcattatacaactatatccgtagctgtatgtgtgtatagttacataatggtaactacacacgatacagaagaatcagtaaattcatggattattttgctgaggttttaaattttaaagcctctgtttcagaattttacacttgatcaaggagaaaaataaatgtgtagtctaacatttgctttctggagttaattaactgatctgtaagaaccactgcatatgtcttaaaatgtaaacatatttacatttgttgtatttgttattgagcctttaaggttaggcccagaatgaacagaccatagcaagtaaacaaataatttttagaatcaaagtattaatagaagaccagttcatggatttgcttattctatcctgctgagacaaaactcatgagtgtgcacacacatgtgaatatatccctacgaaacagtctatcttctcataggcttaaattatagtcatggctattaaagaaattaacagcatccagccacatgcaactttccaaccttcagtactattaggtgattaaaatcaacaaatatgaagtttagttcatttttcccttaaaattccaacaaagatcaaaaggttgtatctagaactaattgccatcaagttccaattcaatgtcatttaaagtaatgtaaccacacatttggtattttcaataggaaggttaattaggtattgtgcaaactgcctgcaacggaagcactcagtccttatctaacttgtcccttcctggccccaacatgctaactgccccatccccaattctgggcaaactgatcacaatgtgcaaaaaataatatattatctatttataattttaaaatatatacagccagctcaaaaacaacaacaaaccccatcaacatagtccagctgaaatctccactgg

SEQ ID NO: 361454 - DNA, 3492 bp, Homo sapiens
tgccacaattccctgagatctcccaggtggcagctgcctccccaagacaggctcactcaccatgaccaagctgagcgcccaagtcaaaggctctctcaacatcaccaccccggggctgcagatatggaggatcgaggccatgcagatggtgcctgttccttccagcacctttggaagcttcttcgatggtgactgctacatcatcctggctatccacaagacagccagcagcctgtcctatgacatccactactggattggccaggactcatccctggatgagcagggggcagctgccatctacaccacacagatggatgacttcctgaagggccgggctgtgcagcaccgcgaggtccagggcaacgagagcgaggccttccgaggctacttcaagcaaggccttgtgatccggaaagggggcgtggcttctggcatgaagcacgtggagaccaactcctatgacgtccagaggctgctgcatgtcaagggcaagaggaacgtggtagctggagaggtagagatgtcctggaagagtttcaaccgaggggatgttttcctcctggaccttgggaagcttatcatccagtggaatggaccggaaagcacccgtatggagagactcaggggcatgactctggccaaggagatccgagaccaggagcggggagggcgcacctatgtaggcgtggtggacggagagaatgaattggcatccccgaagctgatggaggtgatgaaccacgtgctgggcaagcgcagggagctgaaggcggccgtgcccgacacggtggtggagccggcactcaaggctgcactcaaactgtaccatgtgtctgactccgaggggaatctggtggtgagggaagtcgccacacggccactgacacaggacctgctcagtcacgaggactgttacatcctggaccaggggggcctgaagatctacgtgtggaaagggaagaaagccaatgagcaggagaagaagggagccatgagccatgcgctgaacttcatcaaagccaagcagtacccaccaagcacacaggtggaggtgcagaatgatggggctgagtcggccgtctttcagcagctcttccagaagtggacagcgtccaaccggacctcaggcctaggcaaaacccacactgtgggctccgtggccaaagtggaacaggtgaagttcgatgccacatccatgcatgtcaagcctcaggtggctgcccagcagaagatggtagatgatgggagtggggaagtgcaggtgtggcgcattgagaacctagagctggtacctgtggattccaagtggctaggccacttctatgggggcgactgctacctgctgctctacacctacctcatcggcgagaagcagcattacctgctctacgtttggcagggcagccaggccagccaagatgaaattacagcatcagcttatcaagccgtcatcctggaccagaagtacaatggtgaaccagtccagatccgggtcccaatgggcaaggagccacctcatcttatgtccatcttcaagggacgcatggtggtctaccagggaggcacctcccgaactaacaacttggagaccgggccctccacacggctgttccaggtccagggaactggcgccaacaacaccaaggcctttgaggtcccagcgcgggccaatttcctcaattccaatgatgtctttgtcctcaagacccagtcttgctgctatctatggtgtgggaagggttgtagcggggacgagcgggagatggccaagatggttgctgacaccatctcccggacggagaagcaagtggtggtggaagggcaggagccagccaacttctggatggccctgggtgggaaggccccctatgccaacaccaagagactacaggaagaaaacctggtcatcaccccccggctctttgagtgttccaacaagactgggcgcttcctggccacagagatccctgacttcaatcaggatgacttggaagaggatgatgtgttcctactagatgtctgggaccaggtcttcttctggattgggaaacatgccaacgaggaggagaagaaggccgcagcaaccactgcacaggaatacctcaagacccatcccagcgggcgtgaccctgagacccccatcattgtggtgaagcagggacacgagccccccaccttcacaggctggttcctggcttgggatcccttcaagtggagtaacaccaaatcctatgaggacctgaaggcggagcttggcaactctagggactggagccagatcactgctgaggtcacaagccccaaagtggacgtgttcaatgctaacagcaacctcagttctgggcctctgcccatcttccccctggagcagctagtgaacaagcctgtagaggagctccccgagggtgtggaccccagcaggaaggaggaacacctgtccattgaagatttcactcaggcctttgggatgactccagctgccttctctgctctgcctcgatggaagcaacaaaacctcaagaaagaaaaaggactattttgagaagagtagctgtggttgtaaagcagtaccctaccctgattgtagggtctcattttctcaccgatattagtcctacaccaattgaagtgaaattttgcagatgtgcctatgagcacaaacttctgtggcaaatgccagttttgtttaataatgtacctattccttcagaaagatgataccccaaaaggagcctatggtcctcatttcaacttctaaggtcgctagattgtttctatcctgaggtattgcatcaattttaatactcctatagttttctcttcttagaagagcacaaacactccatggaacattagagttctgaggcactaccctagcttgtcctctatcatgactcatttttatctatggcaggtaggctgaagcactttgcaggtttacatcttccccagagtaacagcttttccttttcacatatactttccttactgccttactcagtgggtaagttaaagggctgaaggagagttgaatggtccacaagactaccctcttaagaggtttcacaaattccaaacagtaccagtgagagcagcacttccactggggctaggcttgagacctaaaggcaagtatgaaatgcatatgctacttcactccctctcccaacccttaataatgaggcaaagcaagagcctagtgaaggccaatgctaggtttacaaacttacccagaagcctctgcaaagcttcacaggctcctcagatgaaaataacaggaatcaatggggactacggccagacactggtttgccattctgttccttttaagaagtaacagtgctgcaaggaagtccatgtcagaaagccaacagaaggtgatttccacaactttgaacaggttgttacaagtatcagcaagaatgtgtccttttcagaaataacagtcaaatcaaagaaggttaataaaggctttaatttcatacacac

SEQ ID NO: 361455 - DNA, 5541 bp, Homo sapiens
tgccacaattccctgagatctcccaggtggcagctgcctccccaagacaggctcactcaccatgaccaagctgagcgcccaagtcaaaggctctctcaacatcaccaccccggggctgcagatatggaggatcgaggccatgcagatggtgcctgttccttccagcacctttggaagcttcttcgatggtgactgctacatcatcctggctatccacaagacagccagcagcctgtcctatgacatccactactggattggccaggactcatccctggatgagcagggggcagctgccatctacaccacacagatggatgacttcctgaagggccgggctgtgcagcaccgcgaggtccagggcaacgagagcgaggccttccgaggctacttcaagcaaggccttgtgatccggaaagggggcgtggcttctggcatgaagcacgtggagaccaactcctatgacgtccagaggctgctgcatgtcaagggcaagaggaacgtggtagctggagaggtagagatgtcctggaagagtttcaaccgaggggatgttttcctcctggaccttgggaagcttatcatccagtggaatggaccggaaagcacccgtatggagagactcaggggcatgactctggccaaggagatccgagaccaggagcggggagggcgcacctatgtaggcgtggtggacggagagaatgaattggcatccccgaagctgatggaggtgatgaaccacgtgctgggcaagcgcagggagctgaaggcggccgtgcccgacacggtggtggagccggcactcaaggctgcactcaaactgtaccatgtgtctgactccgaggggaatctggtggtgagggaagtcgccacacggccactgacacaggacctgctcagtcacgaggactgttacatcctggaccaggggggcctgaagatctacgtgtggaaagggaagaaagccaatgagcaggagaagaagggagccatgagccatgcgctgaacttcatcaaagccaagcagtacccaccaagcacacaggtggaggtgcagaatgatggggctgagtcggccgtctttcagcagctcttccagaagtggacagcgtccaaccggacctcaggcctaggcaaaacccacactgtgggctccgtggccaaagtggaacaggtgaagttcgatgccacatccatgcatgtcaagcctcaggtggctgcccagcagaagatggtagatgatgggagtggggaagtgcaggtgtggcgcattgagaacctagagctggtacctgtggattccaagtggctaggccacttctatgggggcgactgctacctgctgctctacacctacctcatcggcgagaagcagcattacctgctctacgtttggcagggcagccaggccagccaagatgaaattacagcatcagcttatcaagccgtcatcctggaccagaagtacaatggtgaaccagtccagatccgggtcccaatgggcaaggagccacctcatcttatgtccatcttcaagggacgcatggtggtctaccagggaggcacctcccgaactaacaacttggagaccgggccctccacacggctgttccaggtccagggaactggcgccaacaacaccaaggcctttgaggtcccagcgcgggccaatttcctcaattccaatgatgtctttgtcctcaagacccagtcttgctgctatctatggtgtgggaagggttgtagcggggacgagcgggagatggccaagatggttgctgacaccatctcccggacggagaagcaagtggtggtggaagggcaggagccagccaacttctggatggccctgggtgggaaggccccctatgccaacaccaagagactacaggaagaaaacctggtcatcaccccccggctctttgagtgttccaacaagactgggcgcttcctggccacagagatccctgacttcaatcaggatgacttggaagaggatgatgtgttcctactagatgtctgggaccaggtcttcttctggattgggaaacatgccaacgaggaggagaagaaggccgcagcaaccactgcacaggaatacctcaagacccatcccagcgggcgtgaccctgagacccccatcattgtggtgaagcagggacacgagccccccaccttcacaggctggttcctggcttgggatcccttcaagtggagtaacaccaaatcctatgaggacctgaaggcggagcttggcaactctagggactggagccagatcactgctgaacacctgtccattgaagatttcactcaggcctttgggatgactccagctgccttctctgctctgcctcgatggaagcaacaaaacctcaagaaagaaaaaggactattttgagaagagtagctgtggttgtaaagcagtaccctaccctgattgtagggtctcattttctcaccgatattagtcctacaccaattgaagtgaaattttgcagatgtgcctatgagcacaaacttctgtggcaaatgccagttttgtttaataatgtacctattccttcagaaagatgataccccaaaaggagcctatggtcctcatttcaacttctaaggtcgctagattgtttctatcctgaggtattgcatcaattttaatactcctatagttttctcttcttagaagagcacaaacactccatggaacattagagttctgaggcactaccctagcttgtcctctatcatgactcatttttatctatggcaggtaggctgaagcactttgcaggtttacatcttccccagagtaacagcttttccttttcacatatactttccttactgccttactcagtgggtaagttaaagggctgaaggagagttgaatggtccacaagactaccctcttaagaggtttcacaaattccaaacagtaccagtgagagcagcacttccactggggctaggcttgagacctaaaggcaagtatgaaatgcatatgctacttcactccctctcccaacccttaataatgaggcaaagcaagagcctagtgaaggccaatgctaggtttacaaacttacccagaagcctctgcaaagcttcacaggctcctcagatgaaaataacaggaatcaatggggactacggccagacactggtttgccattctgttccttttaagaagtaacagtgctgcaaggaagtccatgtcagaaagccaacagaaggtgatttccacaactttgaacaggttgttacaagtatcagcaagaatgtgtccttttcagaaataacagtcaaatcaaagaaggttaataaaggctttaatttcatacacacaaaaaaactctatgcataatttaaaaaggaaacaaaaacaaagaaaaaccgtaaaggatacagaggaacagttctgctaaaacacagataaaagtgccgctccatacaaaacataaagaatcagaatcaaaagtcactctgaacataaagaaaaaaaatcatctcacaaataatgtggccacagctgccagaaaacctggtagtggctcaattaggcaaagtgtaggaatctcatttttgtttttctctccttaagtttaaagaaacaacaatgacaataggccagagaagttagggagggaaagaaaagctcaaagggagggaaacctggggacaagaggtgtgcacacccacatgtggtctcactcttcacacaggcccactatttttgaagtagaccagtttagttgactgttcttctttgttctggcatctgactggaccaacctggaacctggtccagaccctcacccactctattcttatgccaatggacatacctatactttgaacctctgtacttttaagaaaagtccaatgttacaaaatcaaatgcttatattcagactggcacactttttaaataaaaactccatacacctcagacatatagcacacatggagacaacttactaattgtgtgtaagtatgatacaatgaatgagactgcctgaagtctagtaatcaaagcatgccataaggtgaatgattgtggttaaacacagcaaaataattgtcacaaaactttcaaggcctaacaaattagaattttccaataaaaaatatatattttttcagatgttaataagacatatcagtagagacaaaattaggattttgaagtaatgcaataaaaagatgttggagggcagaagtctatttagtttttgtatacacttgcaagagtgcattactcagtataaagcaaaatggggaggaaaaagacatccatccattttattggaacacttttatgtgacttgaatctggtgttaggttgttgatttttctaaaaatctcctatatatacaaaatccatatgtacttggagatccagctgttgccccctgtttaaaacaaaagaccacctcggggggtcaattaaattaaaaaggccctccaaccaccctaaatgggataactaagagtatctactgcagtcatttcagaggacagagaaggaaaatattttaatttgctttaatataacctcttttcagtagatcacaaatgagtttacaaactacttttttttctctttaatttaggtgtttgcagataattttcattatacaactatatccgtagctgtatgtgtgtatagttacataatggtaactacacacgatacagaagaatcagtaaattcatggattattttgctgaggttttaaattttaaagcctctgtttcagaattttacacttgatcaaggagaaaaataaatgtgtagtctaacatttgctttctggagttaattaactgatctgtaagaaccactgcatatgtcttaaaatgtaaacatatttacatttgttgtatttgttattgagcctttaaggttaggcccagaatgaacagaccatagcaagtaaacaaataatttttagaatcaaagtattaatagaagaccagttcatggatttgcttattctatcctgctgagacaaaactcatgagtgtgcacacacatgtgaatatatccctacgaaacagtctatcttctcataggcttaaattatagtcatggctattaaagaaattaacagcatccagccacatgcaactttccaaccttcagtactattaggtgattaaaatcaacaaatatgaagtttagttcatttttcccttaaaattccaacaaagatcaaaaggttgtatctagaactaattgccatcaagttccaattcaatgtcatttaaagtaatgtaaccacacatttggtattttcaataggaaggttaattaggtattgtgcaaactgcctgcaacggaagcactcagtccttatctaacttgtcccttcctggccccaacatgctaactgccccatccccaattctgggcaaactgatcacaatgtgcaaaaaataatatattatctatttataattttaaaatatatacagccagctcaaaaacaacaacaaaccccatcaacatagtccagctgaaatctccactgg

SEQ ID NO: 361456 - DNA, 3358 bp, Homo sapiens
  misc_feature (11)..(11): n is a, c, g, or t
gctgctccagngggaagatgggcagaggcccagaactgaggttgctgttagcattgaacacgtccactttggggctccccgagggtgtggaccccagcaggaaggaggaacacctgtccattgaagatttcactcaggcctttgggatgactccagctgccttctctgctctgcctcgatggaagcaacaaaacctcaagaaagaaaaaggactattttgagaagagtagctgtggttgtaaagcagtaccctaccctgattgtagggtctcattttctcaccgatattagtcctacaccaattgaagtgaaattttgcagatgtgcctatgagcacaaacttctgtggcaaatgccagttttgtttaataatgtacctattccttcagaaagatgataccccaaaaggagcctatggtcctcatttcaacttctaaggtcgctagattgtttctatcctgaggtattgcatcaattttaatactcctatagttttctcttcttagaagagcacaaacactccatggaacattagagttctgaggcactaccctagcttgtcctctatcatgactcatttttatctatggcaggtaggctgaagcactttgcaggtttacatcttccccagagtaacagcttttccttttcacatatactttccttactgccttactcagtgggtaagttaaagggctgaaggagagttgaatggtccacaagactaccctcttaagaggtttcacaaattccaaacagtaccagtgagagcagcacttccactggggctaggcttgagacctaaaggcaagtatgaaatgcatatgctacttcactccctctcccaacccttaataatgaggcaaagcaagagcctagtgaaggccaatgctaggtttacaaacttacccagaagcctctgcaaagcttcacaggctcctcagatgaaaataacaggaatcaatggggactacggccagacactggtttgccattctgttccttttaagaagtaacagtgctgcaaggaagtccatgtcagaaagccaacagaaggtgatttccacaactttgaacaggttgttacaagtatcagcaagaatgtgtccttttcagaaataacagtcaaatcaaagaaggttaataaaggctttaatttcatacacacaaaaaaactctatgcataatttaaaaaggaaacaaaaacaaagaaaaaccgtaaaggatacagaggaacagttctgctaaaacacagataaaagtgccgctccatacaaaacataaagaatcagaatcaaaagtcactctgaacataaagaaaaaaaatcatctcacaaataatgtggccacagctgccagaaaacctggtagtggctcaattaggcaaagtgtaggaatctcatttttgtttttctctccttaagtttaaagaaacaacaatgacaataggccagagaagttagggagggaaagaaaagctcaaagggagggaaacctggggacaagaggtgtgcacacccacatgtggtctcactcttcacacaggcccactatttttgaagtagaccagtttagttgactgttcttctttgttctggcatctgactggaccaacctggaacctggtccagaccctcacccactctattcttatgccaatggacatacctatactttgaacctctgtacttttaagaaaagtccaatgttacaaaatcaaatgcttatattcagactggcacactttttaaataaaaactccatacacctcagacatatagcacacatggagacaacttactaattgtgtgtaagtatgatacaatgaatgagactgcctgaagtctagtaatcaaagcatgccataaggtgaatgattgtggttaaacacagcaaaataattgtcacaaaactttcaaggcctaacaaattagaattttccaataaaaaatatatattttttcagatgttaataagacatatcagtagagacaaaattaggattttgaagtaatgcaataaaaagatgttggagggcagaagtctatttagtttttgtatacacttgcaagagtgcattactcagtataaagcaaaatggggaggaaaaagacatccatccattttattggaacacttttatgtgacttgaatctggtgttaggttgttgatttttctaaaaatctcctatatatacaaaatccatatgtacttggagatccagctgttgccccctgtttaaaacaaaagaccacctcggggggtcaattaaattaaaaaggccctccaaccaccctaaatgggataactaagagtatctactgcagtcatttcagaggacagagaaggaaaatattttaatttgctttaatataacctcttttcagtagatcacaaatgagtttacaaactacttttttttctctttaatttaggtgtttgcagataattttcattatacaactatatccgtagctgtatgtgtgtatagttacataatggtaactacacacgatacagaagaatcagtaaattcatggattattttgctgaggttttaaattttaaagcctctgtttcagaattttacacttgatcaaggagaaaaataaatgtgtagtctaacatttgctttctggagttaattaactgatctgtaagaaccactgcatatgtcttaaaatgtaaacatatttacatttgttgtatttgttattgagcctttaaggttaggcccagaatgaacagaccatagcaagtaaacaaataatttttagaatcaaagtattaatagaagaccagttcatggatttgcttattctatcctgctgagacaaaactcatgagtgtgcacacacatgtgaatatatccctacgaaacagtctatcttctcataggcttaaattatagtcatggctattaaagaaattaacagcatccagccacatgcaactttccaaccttcagtactattaggtgattaaaatcaacaaatatgaagtttagttcatttttcccttaaaattccaacaaagatcaaaaggttgtatctagaactaattgccatcaagttccaattcaatgtcatttaaagtaatgtaaccacacatttggtattttcaataggaaggttaattaggtattgtgcaaactgcctgcaacggaagcactcagtccttatctaacttgtcccttcctggccccaacatgctaactgccccatccccaattctgggcaaactgatcacaatgtgcaaaaaataatatattatctatttataattttaaaatatatacagccagctcaaaaacaacaacaaaccccatcaacatagtccagctgaaatctccactgg

SEQ ID NO: 361457 - DNA, 3441 bp, Homo sapiens
tgccacaattccctgagatctcccaggtggcagctgcctccccaagacaggctcactcaccatgaccaagctgagcgcccaagtcaaaggctctctcaacatcaccaccccggggctgcagatatggaggatcgaggccatgcagatggtgcctgttccttccagcacctttggaagcttcttcgatggtgactgctacatcatcctggctatccacaagacagccagcagcctgtcctatgacatccactactggattggccaggactcatccctggatgagcagggggcagctgccatctacaccacacagatggatgacttcctgaagggccgggctgtgcagcaccgcgaggtccagggcaacgagagcgaggccttccgaggctacttcaagcaaggccttgtgatccggaaagggggcgtggcttctggcatgaagcacgtggagaccaactcctatgacgtccagaggctgctgcatgtcaagggcaagaggaacgtggtagctggagaggtagagatgtcctggaagagtttcaaccgaggggatgttttcctcctggaccttgggaagcttatcatccagtggaatggaccggaaagcacccgtatggagagactcaggggcatgactctggccaaggagatccgagaccaggagcggggagggcgcacctatgtaggcgtggtggacggagagaatgaattggcatccccgaagctgatggaggtgatgaaccacgtgctgggcaagcgcagggagctgaaggcggccgtgcccgacacggtggtggagccggcactcaaggctgcactcaaactgtaccatgtgtctgactccgaggggaatctggtggtgagggaagtcgccacacggccactgacacaggacctgctcagtcacgaggactgttacatcctggaccaggggggcctgaagatctacgtgtggaaagggaagaaagccaatgctaggtttacaaacttacccagaagcctctgcaaagcttcacaggctcctcagatgaaaataacaggaatcaatggggactacggccagacactggtttgccattctgttccttttaagaagtaacagtgctgcaaggaagtccatgtcagaaagccaacagaaggtgatttccacaactttgaacaggttgttacaagtatcagcaagaatgtgtccttttcagaaataacagtcaaatcaaagaaggttaataaaggctttaatttcatacacacaaaaaaactctatgcataatttaaaaaggaaacaaaaacaaagaaaaaccgtaaaggatacagaggaacagttctgctaaaacacagataaaagtgccgctccatacaaaacataaagaatcagaatcaaaagtcactctgaacataaagaaaaaaaatcatctcacaaataatgtggccacagctgccagaaaacctggtagtggctcaattaggcaaagtgtaggaatctcatttttgtttttctctccttaagtttaaagaaacaacaatgacaataggccagagaagttagggagggaaagaaaagctcaaagggagggaaacctggggacaagaggtgtgcacacccacatgtggtctcactcttcacacaggcccactatttttgaagtagaccagtttagttgactgttcttctttgttctggcatctgactggaccaacctggaacctggtccagaccctcacccactctattcttatgccaatggacatacctatactttgaacctctgtacttttaagaaaagtccaatgttacaaaatcaaatgcttatattcagactggcacactttttaaataaaaactccatacacctcagacatatagcacacatggagacaacttactaattgtgtgtaagtatgatacaatgaatgagactgcctgaagtctagtaatcaaagcatgccataaggtgaatgattgtggttaaacacagcaaaataattgtcacaaaactttcaaggcctaacaaattagaattttccaataaaaaatatatattttttcagatgttaataagacatatcagtagagacaaaattaggattttgaagtaatgcaataaaaagatgttggagggcagaagtctatttagtttttgtatacacttgcaagagtgcattactcagtataaagcaaaatggggaggaaaaagacatccatccattttattggaacacttttatgtgacttgaatctggtgttaggttgttgatttttctaaaaatctcctatatatacaaaatccatatgtacttggagatccagctgttgccccctgtttaaaacaaaagaccacctcggggggtcaattaaattaaaaaggccctccaaccaccctaaatgggataactaagagtatctactgcagtcatttcagaggacagagaaggaaaatattttaatttgctttaatataacctcttttcagtagatcacaaatgagtttacaaactacttttttttctctttaatttaggtgtttgcagataattttcattatacaactatatccgtagctgtatgtgtgtatagttacataatggtaactacacacgatacagaagaatcagtaaattcatggattattttgctgaggttttaaattttaaagcctctgtttcagaattttacacttgatcaaggagaaaaataaatgtgtagtctaacatttgctttctggagttaattaactgatctgtaagaaccactgcatatgtcttaaaatgtaaacatatttacatttgttgtatttgttattgagcctttaaggttaggcccagaatgaacagaccatagcaagtaaacaaataatttttagaatcaaagtattaatagaagaccagttcatggatttgcttattctatcctgctgagacaaaactcatgagtgtgcacacacatgtgaatatatccctacgaaacagtctatcttctcataggcttaaattatagtcatggctattaaagaaattaacagcatccagccacatgcaactttccaaccttcagtactattaggtgattaaaatcaacaaatatgaagtttagttcatttttcccttaaaattccaacaaagatcaaaaggttgtatctagaactaattgccatcaagttccaattcaatgtcatttaaagtaatgtaaccacacatttggtattttcaataggaaggttaattaggtattgtgcaaactgcctgcaacggaagcactcagtccttatctaacttgtcccttcctggccccaacatgctaactgccccatccccaattctgggcaaactgatcacaatgtgcaaaaaataatatattatctatttataattttaaaatatatacagccagctcaaaaacaacaacaaaccccatcaacatagtccagctgaaatctccactgg

SEQ ID NO: 361458 - DNA, 1191 bp, Homo sapiens
tgccacaattccctgagatctcccaggtggcagctgcctccccaagacaggctcactcaccatgaccaagctgagcgcccaagtcaaaggctctctcaacatcaccaccccggggctgcagatatggaggatcgaggccatgcagatggtgcctgttccttccagcacctttggaagcttcttcgatggtgactgctacatcatcctggctatccacaagacagccagcagcctgtcctatgacatccactactggattggccaggactcatccctggatgagcagggggcagctgccatctacaccacacagatggatgacttcctgaagggccgggctgtgcagcaccgcgaggtccagggcaacgagagcgaggccttccgaggctacttcaagcaaggccttgtgatccggaaagggggcgtggcttctggcatgaagcacgtggagaccaactcctatgacgtccagaggctgctgcatgtcaagggcaagaggaacgtggtagctggagaggtagagatgtcctggaagagtttcaaccgaggggatgttttcctcctggaccttgggaagcttatcatccagtggaatggaccggaaagcacccgtatggagagactcaggggcatgactctggccaaggagatccgagaccaggagcggggagggcgcacctatgtaggcgtggtggacggagagaatgaattggcatccccgaagctgatggaggtgatgaaccacgtgctgggcaagcgcagggagctgaaggcggccgtgcccgacacggtggtggagccggcactcaaggctgcactcaaactgtaccatgtgtctgactccgaggggaatctggtggtgagggaagtcgccacacggccactgacacaggacctgctcagtcacgaggactgttacatcctggaccaggggggcctgaagatctacgtgtggaaagggaagaaagccaatgagcaggagaagaagggagccatgagccatgcgctgaacttcatcaaagccaagcagtacccaccaagcacacaggtggaggtgcagaatgatggggctgagtcggccgtctttcagcagctcttccagaagtggacagcgtccaaccggacctcaggcctaggcaaaacccacactgtgggctccgtgggtgagggccaggcgggggcagtgaggga

SEQ ID NO: 361459 - DNA, 396 bp, Homo sapiens
tccagggaactggcgccaacaacaccaaggcctttgaggtcccagcgcgggccaatttcctcaattccaatgatgtctttgtcctcaagacccagtcttgctgctatctatggtgtgggaaggtgtgttcagggtctagaggcctccccatccgcaagtgggtcctgggagtcccccagtttcgcagcagccctaggtcagggcaggaacccctggccaactaagttgtgcctgctcaattctcagccgcctctggagcccagtctctccctcctcagtagctctgggtctatccttctgcctcatcaatgaccatcctcagattctctgcctctctgtcggagtcagtctctcttgttctgtttctctggccacctccatctgtccctgtgttgg

SEQ ID NO: 361460 - DNA, 5628 bp, Homo sapiens
tgccacaattccctgagatctcccaggtggcagctgcctccccaagacaggctcactcaccatgaccaagctgagcgcccaagtcaaaggctctctcaacatcaccaccccggggctgcagatatggaggatcgaggccatgcagatggtgcctgttccttccagcacctttggaagcttcttcgatggtgactgctacatcatcctggctatccacaagacagccagcagcctgtcctatgacatccactactggattggccaggactcatccctggatgagcagggggcagctgccatctacaccacacagatggatgacttcctgaagggccgggctgtgcagcaccgcgaggtccagggcaacgagagcgaggccttccgaggctacttcaagcaaggccttgtgatccggaaagggggcgtggcttctggcatgaagcacgtggagaccaactcctatgacgtccagaggctgctgcatgtcaagggcaagaggaacgtggtagctggagaggtagagatgtcctggaagagtttcaaccgaggggatgttttcctcctggaccttgggaagcttatcatccagtggaatggaccggaaagcacccgtatggagagactcaggggcatgactctggccaaggagatccgagaccaggagcggggagggcgcacctatgtaggcgtggtggacggagagaatgaattggcatccccgaagctgatggaggtgatgaaccacgtgctgggcaagcgcagggagctgaaggcggccgtgcccgacacggtggtggagccggcactcaaggctgcactcaaactgtaccatgtgtctgactccgaggggaatctggtggtgagggaagtcgccacacggccactgacacaggacctgctcagtcacgaggactgttacatcctggaccaggggggcctgaagatctacgtgtggaaagggaagaaagccaatgagcaggagaagaagggagccatgagccatgcgctgaacttcatcaaagccaagcagtacccaccaagcacacaggtggaggtgcagaatgatggggctgagtcggccgtctttcagcagctcttccagaagtggacagcgtccaaccggacctcaggcctaggcaaaacccacactgtgggctccgtggccaaagtggaacaggtgaagttcgatgccacatccatgcatgtcaagcctcaggtggctgcccagcagaagatggtagatgatgggagtggggaagtgcaggtgtggcgcattgagaacctagagctggtacctgtggattccaagtggctaggccacttctatgggggcgactgctacctgctgctctacacctacctcatcggcgagaagcagcattacctgctctacgtttggcagggcagccaggccagccaagatgaaattacagcatcagcttatcaagccgtcatcctggaccagaagtacaatggtgaaccagtccagatccgggtcccaatgggcaaggagccacctcatcttatgtccatcttcaagggacgcatggtggtctaccagggaggcacctcccgaactaacaacttggagaccgggccctccacacggctgttccaggtccagggaactggcgccaacaacaccaaggcctttgaggtcccagcgcgggccaatttcctcaattccaatgatgtctttgtcctcaagacccagtcttgctgctatctatggtgtgggaagggttgtagcggggacgagcgggagatggccaagatggttgctgacaccatctcccggacggagaagcaagtggtggtggaagggcaggagccagccaacttctggatggccctgggtgggaaggccccctatgccaacaccaagagactacaggaagaaaacctggtcatcaccccccggctctttgagtgttccaacaagactgggcgcttcctggccacagagatccctgacttcaatcaggatgacttggaagaggatgatgtgttcctactagatgtctgggaccaggtcttcttctggattgggaaacatgccaacgaggaggagaagaaggccgcagcaaccactgcacaggaatacctcaagacccatcccagcgggcgtgaccctgagacccccatcattgtggtgaagcagggacacgagccccccaccttcacaggctggttcctggcttgggatcccttcaagtggagtaacaccaaatcctatgaggacctgaaggcggagcttggcaactctagggactggagccagatcactgctgaggtcacaagccccaaagtggacgtgttcaatgctaacagcaacctcagttctgggcctctgcccatcttccccctggagcagctagtgaacaagcctgtagaggagctccccgagggtgtggaccccagcaggaaggaggaacacctgtccattgaagatttcactcaggcctttgggatgactccagctgccttctctgctctgcctcgatggaagcaacaaaacctcaagaaagaaaaaggactattttgagaagagtagctgtggttgtaaagcagtaccctaccctgattgtagggtctcattttctcaccgatattagtcctacaccaattgaagtgaaattttgcagatgtgcctatgagcacaaacttctgtggcaaatgccagttttgtttaataatgtacctattccttcagaaagatgataccccaaaaggagcctatggtcctcatttcaacttctaaggtcgctagattgtttctatcctgaggtattgcatcaattttaatactcctatagttttctcttcttagaagagcacaaacactccatggaacattagagttctgaggcactaccctagcttgtcctctatcatgactcatttttatctatggcaggtaggctgaagcactttgcaggtttacatcttccccagagtaacagcttttccttttcacatatactttccttactgccttactcagtgggtaagttaaagggctgaaggagagttgaatggtccacaagactaccctcttaagaggtttcacaaattccaaacagtaccagtgagagcagcacttccactggggctaggcttgagacctaaaggcaagtatgaaatgcatatgctacttcactccctctcccaacccttaataatgaggcaaagcaagagcctagtgaaggccaatgctaggtttacaaacttacccagaagcctctgcaaagcttcacaggctcctcagatgaaaataacaggaatcaatggggactacggccagacactggtttgccattctgttccttttaagaagtaacagtgctgcaaggaagtccatgtcagaaagccaacagaaggtgatttccacaactttgaacaggttgttacaagtatcagcaagaatgtgtccttttcagaaataacagtcaaatcaaagaaggttaataaaggctttaatttcatacacacaaaaaaactctatgcataatttaaaaaggaaacaaaaacaaagaaaaaccgtaaaggatacagaggaacagttctgctaaaacacagataaaagtgccgctccatacaaaacataaagaatcagaatcaaaagtcactctgaacataaagaaaaaaaatcatctcacaaataatgtggccacagctgccagaaaacctggtagtggctcaattaggcaaagtgtaggaatctcatttttgtttttctctccttaagtttaaagaaacaacaatgacaataggccagagaagttagggagggaaagaaaagctcaaagggagggaaacctggggacaagaggtgtgcacacccacatgtggtctcactcttcacacaggcccactatttttgaagtagaccagtttagttgactgttcttctttgttctggcatctgactggaccaacctggaacctggtccagaccctcacccactctattcttatgccaatggacatacctatactttgaacctctgtacttttaagaaaagtccaatgttacaaaatcaaatgcttatattcagactggcacactttttaaataaaaactccatacacctcagacatatagcacacatggagacaacttactaattgtgtgtaagtatgatacaatgaatgagactgcctgaagtctagtaatcaaagcatgccataaggtgaatgattgtggttaaacacagcaaaataattgtcacaaaactttcaaggcctaacaaattagaattttccaataaaaaatatatattttttcagatgttaataagacatatcagtagagacaaaattaggattttgaagtaatgcaataaaaagatgttggagggcagaagtctatttagtttttgtatacacttgcaagagtgcattactcagtataaagcaaaatggggaggaaaaagacatccatccattttattggaacacttttatgtgacttgaatctggtgttaggttgttgatttttctaaaaatctcctatatatacaaaatccatatgtacttggagatccagctgttgccccctgtttaaaacaaaagaccacctcggggggtcaattaaattaaaaaggccctccaaccaccctaaatgggaaatttgctttaatataacctcttttcagtagatcacaaatgagtttacaaactacttttttttctctttaatttaggtgtttgcagataattttcattatacaactatatccgtagctgtatgtgtgtatagttacataatggtaactacacacgatacagaagaatcagtaaattcatggattattttgctgaggttttaaattttaaagcctctgtttcagaattttacacttgatcaaggagaaaaataaatgtgtagtctaacatttgctttctggagttaattaactgatctgtaagaaccactgcatatgtcttaaaatgtaaacatatttacatttgttgtatttgttattgagcctttaaggttaggcccagaatgaacagaccatagcaagtaaacaaataatttttagaatcaaagtattaatagaagaccagttcatggatttgcttattctatcctgctgagacaaaactcatgagtgtgcacacacatgtgaatatatccctacgaaacagtctatcttctcataggcttaaattatagtcatggctattaaagaaattaacagcatccagccacatgcaactttccaaccttcagtactattaggtgattaaaatcaacaaatatgaagtttagttcatttttcccttaaaattccaacaaagatcaaaaggttgtatctagaactaattgccatcaagttccaattcaatgtcatttaaagtaatgtaaccacacatttggtattttcaataggaaggttaattaggtattgtgcaaactgcctgcaacggaagcactcagtccttatctaacttgtcccttcctggccccaacatgctaactgccccatccccaattctgggcaaactgatcacaatgtgcaaaaaataatatattatctatttataattttaaaatatatacagccagctcaaaaacaacaacaaaccccatcaacatagtccagctgaaatctccactgg

SEQ ID NO: 361461 - DNA, 5628 bp, Homo sapiens
tgccacaattccctgagatctcccaggtggcagctgcctccccaagacaggctcactcaccatgaccaagctgagcgcccaagtcaaaggctctctcaacatcaccaccccggggctgcagatatggaggatcgaggccatgcagatggtgcctgttccttccagcacctttggaagcttcttcgatggtgactgctacatcatcctggctatccacaagacagccagcagcctgtcctatgacatccactactggattggccaggactcatccctggatgagcagggggcagctgccatctacaccacacagatggatgacttcctgaagggccgggctgtgcagcaccgcgaggtccagggcaacgagagcgaggccttccgaggctacttcaagcaaggccttgtgatccggaaagggggcgtggcttctggcatgaagcacgtggagaccaactcctatgacgtccagaggctgctgcatgtcaagggcaagaggaacgtggtagctggagaggtagagatgtcctggaagagtttcaaccgaggggatgttttcctcctggaccttgggaagcttatcatccagtggaatggaccggaaagcacccgtatggagagactcaggggcatgactctggccaaggagatccgagaccaggagcggggagggcgcacctatgtaggcgtggtggacggagagaatgaattggcatccccgaagctgatggaggtgatgaaccacgtgctgggcaagcgcagggagctgaaggcggccgtgcccgacacggtggtggagccggcactcaaggctgcactcaaactgtaccatgtgtctgactccgaggggaatctggtggtgagggaagtcgccacacggccactgacacaggacctgctcagtcacgaggactgttacatcctggaccaggggggcctgaagatctacgtgtggaaagggaagaaagccaatgagcaggagaagaagggagccatgagccatgcgctgaacttcatcaaagccaagcagtacccaccaagcacacaggtggaggtgcagaatgatggggctgagtcggccgtctttcagcagctcttccagaagtggacagcgtccaaccggacctcaggcctaggcaaaacccacactgtgggctccgtggccaaagtggaacaggtgaagttcgatgccacatccatgcatgtcaagcctcaggtggctgcccagcagaagatggtagatgatgggagtggggaagtgcaggtgtggcgcattgagaacctagagctggtacctgtggattccaagtggctaggccacttctatgggggcgactgctacctgctgctctacacctacctcatcggcgagaagcagcattacctgctctacgtttggcagggcagccaggccagccaagatgaaattacagcatcagcttatcaagccgtcatcctggaccagaagtacaatggtgaaccagtccagatccgggtcccaatgggcaaggagccacctcatcttatgtccatcttcaagggacgcatggtggtctaccagggaggcacctcccgaactaacaacttggagaccgggccctccacacggctgttccaggtccagggaactggcgccaacaacaccaaggcctttgaggtcccagcgcgggccaatttcctcaattccaatgatgtctttgtcctcaagacccagtcttgctgctatctatggtgtgggaagggttgtagcggggacgagcgggagatggccaagatggttgctgacaccatctcccggacggagaagcaagtggtggtggaagggcaggagccagccaacttctggatggccctgggtgggaaggccccctatgccaacaccaagagactacaggaagaaaacctggtcatcaccccccggctctttgagtgttccaacaagactgggcgcttcctggccacagagatccctgacttcaatcaggatgacttggaagaggatgatgtgttcctactagatgtctgggaccaggtcttcttctggattgggaaacatgccaacgaggaggagaagaaggccgcagcaaccactgcacaggaatacctcaagacccatcccagcgggcgtgaccctgagacccccatcattgtggtgaagcagggacacgagccccccaccttcacaggctggttcctggcttgggatcccttcaagtggagtaacaccaaatcctatgaggacctgaaggcggagcttggcaactctagggactggagccagatcactgctgaggtcacaagccccaaagtggacgtgttcaatgctaacagcaacctcagttctgggcctctgcccatcttccccctggagcagctagtgaacaagcctgtagaggagctccccgagggtgtggaccccagcaggaaggaggaacacctgtccattgaagatttcactcaggcctttgggatgactccagctgccttctctgctctgcctcgatggaagcaacaaaacctcaagaaagaattgtagggtctcattttctcaccgatattagtcctacaccaattgaagtgaaattttgcagatgtgcctatgagcacaaacttctgtggcaaatgccagttttgtttaataatgtacctattccttcagaaagatgataccccaaaaggagcctatggtcctcatttcaacttctaaggtcgctagattgtttctatcctgaggtattgcatcaattttaatactcctatagttttctcttcttagaagagcacaaacactccatggaacattagagttctgaggcactaccctagcttgtcctctatcatgactcatttttatctatggcaggtaggctgaagcactttgcaggtttacatcttccccagagtaacagcttttccttttcacatatactttccttactgccttactcagtgggtaagttaaagggctgaaggagagttgaatggtccacaagactaccctcttaagaggtttcacaaattccaaacagtaccagtgagagcagcacttccactggggctaggcttgagacctaaaggcaagtatgaaatgcatatgctacttcactccctctcccaacccttaataatgaggcaaagcaagagcctagtgaaggccaatgctaggtttacaaacttacccagaagcctctgcaaagcttcacaggctcctcagatgaaaataacaggaatcaatggggactacggccagacactggtttgccattctgttccttttaagaagtaacagtgctgcaaggaagtccatgtcagaaagccaacagaaggtgatttccacaactttgaacaggttgttacaagtatcagcaagaatgtgtccttttcagaaataacagtcaaatcaaagaaggttaataaaggctttaatttcatacacacaaaaaaactctatgcataatttaaaaaggaaacaaaaacaaagaaaaaccgtaaaggatacagaggaacagttctgctaaaacacagataaaagtgccgctccatacaaaacataaagaatcagaatcaaaagtcactctgaacataaagaaaaaaaatcatctcacaaataatgtggccacagctgccagaaaacctggtagtggctcaattaggcaaagtgtaggaatctcatttttgtttttctctccttaagtttaaagaaacaacaatgacaataggccagagaagttagggagggaaagaaaagctcaaagggagggaaacctggggacaagaggtgtgcacacccacatgtggtctcactcttcacacaggcccactatttttgaagtagaccagtttagttgactgttcttctttgttctggcatctgactggaccaacctggaacctggtccagaccctcacccactctattcttatgccaatggacatacctatactttgaacctctgtacttttaagaaaagtccaatgttacaaaatcaaatgcttatattcagactggcacactttttaaataaaaactccatacacctcagacatatagcacacatggagacaacttactaattgtgtgtaagtatgatacaatgaatgagactgcctgaagtctagtaatcaaagcatgccataaggtgaatgattgtggttaaacacagcaaaataattgtcacaaaactttcaaggcctaacaaattagaattttccaataaaaaatatatattttttcagatgttaataagacatatcagtagagacaaaattaggattttgaagtaatgcaataaaaagatgttggagggcagaagtctatttagtttttgtatacacttgcaagagtgcattactcagtataaagcaaaatggggaggaaaaagacatccatccattttattggaacacttttatgtgacttgaatctggtgttaggttgttgatttttctaaaaatctcctatatatacaaaatccatatgtacttggagatccagctgttgccccctgtttaaaacaaaagaccacctcggggggtcaattaaattaaaaaggccctccaaccaccctaaatgggataactaagagtatctactgcagtcatttcagaggacagagaaggaaaatattttaatttgctttaatataacctcttttcagtagatcacaaatgagtttacaaactacttttttttctctttaatttaggtgtttgcagataattttcattatacaactatatccgtagctgtatgtgtgtatagttacataatggtaactacacacgatacagaagaatcagtaaattcatggattattttgctgaggttttaaattttaaagcctctgtttcagaattttacacttgatcaaggagaaaaataaatgtgtagtctaacatttgctttctggagttaattaactgatctgtaagaaccactgcatatgtcttaaaatgtaaacatatttacatttgttgtatttgttattgagcctttaaggttaggcccagaatgaacagaccatagcaagtaaacaaataatttttagaatcaaagtattaatagaagaccagttcatggatttgcttattctatcctgctgagacaaaactcatgagtgtgcacacacatgtgaatatatccctacgaaacagtctatcttctcataggcttaaattatagtcatggctattaaagaaattaacagcatccagccacatgcaactttccaaccttcagtactattaggtgattaaaatcaacaaatatgaagtttagttcatttttcccttaaaattccaacaaagatcaaaaggttgtatctagaactaattgccatcaagttccaattcaatgtcatttaaagtaatgtaaccacacatttggtattttcaataggaaggttaattaggtattgtgcaaactgcctgcaacggaagcactcagtccttatctaacttgtcccttcctggccccaacatgctaactgccccatccccaattctgggcaaactgatcacaatgtgcaaaaaataatatattatctatttataattttaaaatatatacagccagctcaaaaacaacaacaaaccccatcaacatagtccagctgaaatctccactgg

SEQ ID NO: 361462 - DNA, 4086 bp, Homo sapiens
tgccacaattccctgagatctcccaggtggcagctgcctccccaagacaggctcactcaccatgaccaagctgagcgcccaagtcaaaggctctctcaacatcaccaccccggggctgcagatatggaggatcgaggccatgcagatggtgcctgttccttccagcacctttggaagcttcttcgatggtgactgctacatcatcctggctatccacaagacagccagcagcctgtcctatgacatccactactggattggccaggactcatccctggatgagcagggggcagctgccatctacaccacacagatggatgacttcctgaagggccgggctgtgcagcaccgcgaggtccagggcaacgagagcgaggccttccgaggctacttcaagcaaggccttgtgatccggaaagggggcgtggcttctggcatgaagcacgtggagaccaactcctatgacgtccagaggctgctgcatgtcaagggcaagaggaacgtggtagctggagaggtagagatgtcctggaagagtttcaaccgaggggatgttttcctcctggaccttgggaagcttatcatccagtggaatggaccggaaagcacccgtatggagagactcaggggcatgactctggccaaggagatccgagaccaggagcggggagggcgcacctatgtaggcgtggtggacggagagaatgaattggcatccccgaagctgatggaggtgatgaaccacgtgctgggcaagcgcagggagctgaaggcggccgtgcccgacacggtggtggagccggcactcaaggctgcactcaaactgtaccatgtgtctgactccgaggggaatctggtggtgagggaagtcgccacacggccactgacacaggacctgctcagtcacgaggactgttacatcctggaccaggggggcctgaagatctacgtgtggaaagggaagaaagccaatgagcaggagaagaagggagccatgagccatgcgctgaacttcatcaaagccaagcagtacccaccaagcacacaggtggaggtgcagaatgatggggctgagtcggccgtctttcagcagctcttccagaagtggacagcgtccaaccggacctcaggcctaggcaaaacccacactgtgggctccgtggccaaagtggaacaggtgaagttcgatgccacatccatgcatgtcaagcctcaggtggctgcccagcagaagatggtagatgatgggagtggggaagtgcaggtgtggcgcattgagaacctagagctggtacctgtggattccaagtggctaggccacttctatgggggcgactgctacctgctgctctacacctacctcatcggcgagaagcagcattacctgctctacgtttggcagggcagccaggccagccaagatgaaattacagcatcagcttatcaagccgtcatcctggaccagaagtacaatggtgaaccagtccagatccgggtcccaatgggcaaggagccacctcatcttatgtccatcttcaagggacgcatggtggtctaccagcactccctctcccaacccttaataatgaggcaaagcaagagcctagtgaaggccaatgctaggtttacaaacttacccagaagcctctgcaaagcttcacaggctcctcagatgaaaataacaggaatcaatggggactacggccagacactggtttgccattctgttccttttaagaagtaacagtgctgcaaggaagtccatgtcagaaagccaacagaaggtgatttccacaactttgaacaggttgttacaagtatcagcaagaatgtgtccttttcagaaataacagtcaaatcaaagaaggttaataaaggctttaatttcatacacacaaaaaaactctatgcataatttaaaaaggaaacaaaaacaaagaaaaaccgtaaaggatacagaggaacagttctgctaaaacacagataaaagtgccgctccatacaaaacataaagaatcagaatcaaaagtcactctgaacataaagaaaaaaaatcatctcacaaataatgtggccacagctgccagaaaacctggtagtggctcaattaggcaaagtgtaggaatctcatttttgtttttctctccttaagtttaaagaaacaacaatgacaataggccagagaagttagggagggaaagaaaagctcaaagggagggaaacctggggacaagaggtgtgcacacccacatgtggtctcactcttcacacaggcccactatttttgaagtagaccagtttagttgactgttcttctttgttctggcatctgactggaccaacctggaacctggtccagaccctcacccactctattcttatgccaatggacatacctatactttgaacctctgtacttttaagaaaagtccaatgttacaaaatcaaatgcttatattcagactggcacactttttaaataaaaactccatacacctcagacatatagcacacatggagacaacttactaattgtgtgtaagtatgatacaatgaatgagactgcctgaagtctagtaatcaaagcatgccataaggtgaatgattgtggttaaacacagcaaaataattgtcacaaaactttcaaggcctaacaaattagaattttccaataaaaaatatatattttttcagatgttaataagacatatcagtagagacaaaattaggattttgaagtaatgcaataaaaagatgttggagggcagaagtctatttagtttttgtatacacttgcaagagtgcattactcagtataaagcaaaatggggaggaaaaagacatccatccattttattggaacacttttatgtgacttgaatctggtgttaggttgttgatttttctaaaaatctcctatatatacaaaatccatatgtacttggagatccagctgttgccccctgtttaaaacaaaagaccacctcggggggtcaattaaattaaaaaggccctccaaccaccctaaatgggataactaagagtatctactgcagtcatttcagaggacagagaaggaaaatattttaatttgctttaatataacctcttttcagtagatcacaaatgagtttacaaactacttttttttctctttaatttaggtgtttgcagataattttcattatacaactatatccgtagctgtatgtgtgtatagttacataatggtaactacacacgatacagaagaatcagtaaattcatggattattttgctgaggttttaaattttaaagcctctgtttcagaattttacacttgatcaaggagaaaaataaatgtgtagtctaacatttgctttctggagttaattaactgatctgtaagaaccactgcatatgtcttaaaatgtaaacatatttacatttgttgtatttgttattgagcctttaaggttaggcccagaatgaacagaccatagcaagtaaacaaataatttttagaatcaaagtattaatagaagaccagttcatggatttgcttattctatcctgctgagacaaaactcatgagtgtgcacacacatgtgaatatatccctacgaaacagtctatcttctcataggcttaaattatagtcatggctattaaagaaattaacagcatccagccacatgcaactttccaaccttcagtactattaggtgattaaaatcaacaaatatgaagtttagttcatttttcccttaaaattccaacaaagatcaaaaggttgtatctagaactaattgccatcaagttccaattcaatgtcatttaaagtaatgtaaccacacatttggtattttcaataggaaggttaattaggtattgtgcaaactgcctgcaacggaagcactcagtccttatctaacttgtcccttcctggccccaacatgctaactgccccatccccaattctgggcaaactgatcacaatgtgcaaaaaataatatattatctatttataattttaaaatatatacagccagctcaaaaacaacaacaaaccccatcaacatagtccagctgaaatctccactgg

SEQ ID NO: 361463 - DNA, 2826 bp, Homo sapiens
tgccacaattccctgagatctcccaggtggcagctgcctccccaagacaggctcactcaccatgaccaagctgagcgcccaagtcaaaggctctctcaacatcaccaccccggggctgcagatatggaggatcgaggccatgcagatggtgcctgttccttccagcacctttggaagcttcttcgatggtgactgctacatcatcctggctatccacaagacagccagcagcctgtcctatgacatccactactggattggccaggactcatccctggatgagcagggggcagctgccatctacaccacacagatggatgacttcctgaagggccgggctgtgcagcaccgcgaggtccagggcaacgagagcgaggccttccgaggctacttcaagcaaggccttgtgatccggaaagggggcgtggcttctggcatgaagcacgtggagaccaactcctatgacgtccagaggctgctgcatgtcaagggcaagaggaacgtggtagctggagaggtagagatgtcctggaagagtttcaaccgaggggatgttttcctcctggaccttgggaagcttatcatccagtggaatggaccggaaagcacccgtatggagagactcaggggcatgactctggccaaggagatccgagaccaggagcggggagggcgcacctatgtaggcgtggtggacggagagaatgaattggcatccccgaagctgatggaggtgatgaaccacgtgctgggcaagcgcagggagctgaaggcggccgtgcccgacacggtggtggagccggcactcaaggctgcactcaaactgtaccatgtgtctgactccgaggggaatctggtggtgagggaagtcgccacacggccactgacacaggacctgctcagtcacgaggactgttacatcctggaccaggggggcctgaagatctacgtgtggaaagggaagaaagccaatgagcaggagaagaagggagccatgagccatgcgctgaacttcatcaaagccaagcagtacccaccaagcacacaggtggaggtgcagaatgatggggctgagtcggccgtctttcagcagctcttccagaagtggacagcgtccaaccggacctcaggcctaggcaaaacccacactgtgggctccgtggccaaagtggaacaggtgaagttcgatgccacatccatgcatgtcaagcctcaggtggctgcccagcagaagatggtagatgatgggagtggggaagtgcaggtgtggcgcattgagaacctagagctggtacctgtggattccaagtggctaggccacttctatgggggcgactgctacctgctgctctacacctacctcatcggcgagaagcagcattacctgctctacgtttggcagggcagccaggccagccaagatgaaattacagcatcagcttatcaagccgtcatcctggaccagaagtacaatggtgaaccagtccagatccgggtcccaatgggcaaggagccacctcatcttatgtccatcttcaagggacgcatggtggtctaccagggaggcacctcccgaactaacaacttggagaccgggccctccacacggctgttccaggtccagggaactggcgccaacaacaccaaggcctttgaggtcccagcgcgggccaatttcctcaattccaatgatgtctttgtcctcaagacccagtcttgctgctatctatggtgtgggaagggttgtagcggggacgagcgggagatggccaagatggttgctgacaccatctcccggacggagaagcaagtggtggtggaagggcaggagccagccaacttctggatggccctgggtgggaaggccccctatgccaacaccaagagactacaggaagaaaacctggtcatcaccccccggctctttgagtgttccaacaagactgggcgcttcctggccacagagatccctgacttcaatcaggatgacttggaagaggatgatgtgttcctactagatgtctgggaccaggtcttcttctggattgggaaacatgccaacgaggaggagaagaaggccgcagcaaccactgcacaggaatacctcaagacccatcccagcgggcgtgaccctgagacccccatcattgtggtgaagcagggacacgagccccccaccttcacaggctggttcctggcttgggatcccttcaagtggagtaacaccaaatcctatgaggacctgaaggcggagcttggcaactctagggactggagccagatcactgctgaacacctgtccattgaagatttcactcaggcctttgggatgactccagctgccttctctgctctgcctcgatggaagcaacaaaacctcaagaaagaaaaaggactattttgagaagagtagctgtggttgtaaagcagtaccctaccctgattgtagggtctcattttctcaccgatattagtcctacaccaattgaagtgaaattttgcagatgtgcctatgagcacaaacttctgtggcaaatgccagttttgtttaataatgtacctattccttcagaaagatgataccccaaaaggaaaaaaaaaaaaaaaaaaaaaaaaaaaaaaaaaaaaaaaaaaaaaaaaaaaaaaaaaaaaaaaaaaaaaaaaaaaaaaaagagggaaaagaaaaaaacaaaaaaaaaaaaaaaaaaaatttttggggggggggcccggcccccaatttccctttaagggggggtttttccccccccccccggccccttttttaaaaacgcggggggggagaaaaacttggggacacccaattat

SEQ ID NO: 361464 - DNA, 330 bp, Homo sapiens
ccaagatgaaattacagcatcagcttatcaagccgtcatcctggaccagaagtacaatggtgaaccagtccagatccgggtcccaatgggcaaggagccacctcatcttatgtccatcttcaagggacgcatggtggtctaccagtgtggctgctgaactgaggtgtctggcagtaaccactgtggcaagacaggcatccgggagatggagaaggggatgggtggtgggagcagggcttgaggtgaagcccattcttcataggagactaccctggaggttctatcacctatgtggaactggtaatagaaacaacccatttggttacttta

SEQ ID NO: 361465 - DNA, 295 bp, Homo sapiens
actacaggaagaaaacctggtcatcaccccccggctctttgagtgttccaacaagactgggcgcttcctggccacagagatccctgacttcaatcaggatgacttggaagaggatgatgtgttcctactagatgtctgggaccaggtaggaccaagggcctggggacccctcttcccagccacctcaatccccagggccaagaaagagtggctttaaggttaggtaagtgtcaatgttttcttggcccttacataatttctccctggaaatggtatgaacaccagaagtgtaaga

SEQ ID NO: 361466 - DNA, 1730 bp, Homo sapiens
gcggtgcgcgcgcctcgacatccgggcaacgcctctgttctgtcctcccccttcgtcgcctgtgacaaccggaagggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaatttaaatgcgactgtggtataaacagtaaaatgatttaaaagtaagtcattccgtttttattaatttactgttaagtcatgttctcatgctcagatcagtagtgtcagccagagctttctctgcagacatgtaggaagtgggtagctatttttcccactccatgtattagagttttacaaaaaggcttacttttgagacaactgttgcattttggggtactaataaatgattgccgatgagttat

SEQ ID NO: 361467 - DNA, 2933 bp, Homo sapiens
gcggtgcgcgcgcctcgacatccgggcaacgcctctgttctgtcctcccccttcgtcgcctgtgacaaccggaagggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaatttaaatgcgactgtggtataaacagtaaaatgatttaaaagtaagtcattccgtttttattaatttactgttaagtcatgttctcatgctcagatcagtagtgtcagccagagctttctctgcagacatgtaggaagtgggtagctatttttcccactccatgtattagagttttacaaaaaggcttacttttgagacaactgttgcattttggggtactaataaatgattgccgatgagttatgagggcattataatacttccttatttgctaattaagaaaataactagttcctattttagagtaagaaataaggtaactttttactatttataagtgataaaaacttgctttcatatatgaagatgaagcatttgagtggccacatcaggtgtctgaggtttttagtactgtttgatttggcatgagccatccatggggactcagtctttctcgcatccatttccaggcatttttgacatgattagccatggaataatgtttagttctgaaattgagactttgacaagtcaaagagcacagctggaatgcaagtcaagtatgatttgatttaatttgatctttatattttaagaattacgtactgcctttctaggaggcaaaaattagtttgaagtagggatccagattagtggttttccacatgtaggtaaattcaatgtaaagcaacaagccaaaggaccctagatttctcctgtggcttcttaaatacctggaatgtattggccttgttaaaatacttacaaaagtgcagatgactttatagtttagcatttgttaaaaagaaatcaagaaaacaatggacacataatttgttgtgtggagtcagttatctgaaacataggagaagaatatagatcaggaataggaatggaaagctgaactgtggtgacaggtgtatatatgtaagaaactttttgtttgttggtgtatgatttatgacctttgggagatgtacagcagaaaaaaaggagaaatgaagactggagaaacaaaatatgttatatatttgccaataattcacatgctgcctcagtgtcctcagatcccaggctgcacataaggtccatttgcctgagtattattacatacctccttctccagaaaactttcaagttcacagccttgcgttgtccatctttaatacacttagttgttggttttaataattaaggaaacaggacctacctatacctgtgccaacagggggcactatccctctgtaaagaacaaatcaaaaagtattttgtgttgtagctggaggatccaatggtcttgcttttggcaaaaacttgaagaggagggtggtctttacatgtgtggaaaccttgagtggccgagcaaatagcaagagaaattgcttagtggcttttaaaatttgaaatataattttactttttatttttacaatacagtgtacagtat

SEQ ID NO: 361468 - DNA, 2475 bp, Homo sapiens
gcggtgcgcgcgcctcgacatccgggcaacgcctctgttctgtcctcccccttcgtcgcctgtgacaaccggaagggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaatttaaatgcgactgtggtataaacagtaaaatgatttaaaagtaagtcattccgtttttattaatttactgttaagtcatgttctcatgctcagatcagtagtgtcagccagagctttctctgcagacatgtaggaagtgggtagctatttttcccactccatgtattagagttttacaaaaaggcttacttttgagacaactgttgcattttggggtactaataaatgattgccgatgagttatgagggcattataatacttccttatttgctaattaagaaaataactagttcctattttagagtaagaaataaggtaactttttactatttataagtgataaaaacttgctttcatatatgaagatgaagcatttgagtggccacatcaggtgtctgaggtttttagtactgtttgatttggcatgagccatccatggggactcagtctttctcgcatccatttccaggcatttttgacatgattagccatggaataatgtttagttctgaaattgtgacactgtctttattaatactgtattttaatcaagtgacatcacagtccaggtagtttttctttcttttttttttttttgaaacagagtctcactcattctgtagcccaggctagagtgcagtggcagcaacatcagttcactgcaacgtccgcctcctcaattcaagagattctcctgcttcagtctcccgagtagctgggattacaggtttgcgccaccatgcccggctaatgtttatatttttagtggagatggggtttcaccatgttggccaggctggtcttgaactcctgacctcaagtaatctgcctgcctcggcctcccaaagtgctgggattacaggcataagccaccatgcccagccagtctaggcagttttaaagtactaaatgattttgcaagcatttaacatctcctataagatagcaggtcttagttatgtgccaggcactggtattaagtattttg

SEQ ID NO: 361469 - DNA, 2398 bp, Homo sapiens
  misc_feature (1744)..(1744): n is a, c, g, or t
  misc_feature (1750)..(1750): n is a, c, g, or t
  misc_feature (1758)..(1758): n is a, c, g, or t
  misc_feature (1760)..(1760): n is a, c, g, or t
  misc_feature (1762)..(1762): n is a, c, g, or t
gcggtgcgcgcgcctcgacatccgggcaacgcctctgttctgtcctcccccttcgtcgcctgtgacaaccggaagggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaatttaaatgcgactgtggtataaacagtaaaatgatttaaaagtaagtcattccgtttttattaatttactgttaagtcatgttctcatgctcagatcagtagtgtcagccagagctttctctgcagacatgtaggaagtgggtagctatttttcccactccatgtattagagttttacaaaaaggcttacttttgagacaactgttgcattttggggtactaataaatgattgccgatgagttataaaaaaaaaaaaanaaaaanaaaaaaanananaaaaaaggggcggggcgcgcctaaaaagtaccccctcaggggccccaaggttataccagtccccaggtttcttggttacaaagggggcgccccaatatagggaggccggtatatataataagcgcaagggaccacgggcgccgcgcgtttaacacaccgttcgggagcatgggggaaaacaacggcgcctacgcgtggggacacccttggggaagggacccctaactcttcgggcggtgggagcccatatttggcggaccaaccatccctcgacaggaagattataacggctccaagggagaacatatttaacactttcaccggggtgttcaaccgtgggtgtgttaacccccaccgggcggaaatattttgcgtggggcggttggaagagagttgcgggcccaaaccggagagttattgaattatctgcggacacctacattttttttctacccgcggggactttttctggatcatatatacgggctataggccagagatgcaccgacacataccagcacccagacgcacaattaacaacacgtgctagcgacacgatctgtattccgtcacaagacacacccacggcatatgccagctgcgttgctaaagcgaccacctcgagagacgcagcta

SEQ ID NO: 361470 - DNA, 1676 bp, Homo sapiens
gcggtgcgcgcgcctcgacatccgggcaacgcctctgttctgtcctcccccttcgtcgcctgtgacaaccggaagggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggatgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaatttaaatgcgactgtggtataaacagtaaaatgatttaaaagtaagtcattccgtttttattaatttactgttaagtcatgttctcatgctcagatcagtagtgtcagccagagctttctctgcagacatgtaggaagtgggtagctatttttcccactccatgtattagagttttacaaaaaggcttacttttgagacaactgttgcattttggggtactaataaatgattgccgatgagttat

SEQ ID NO: 361471 - DNA, 1513 bp, Homo sapiens
gtatcaacgcagagtggccattacggggccgggccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaatttaaatgcgactgtggtataaacagtaaaatgatttaaaagtaagtcattccgtttttattaatttactgttaagtcatgttctcatgctcagatcagtagtgtcagccagagctttctctgcagacatgtaggaagtgggtagctatttttcccactccatgtattagagttttacaaaaaggcttacttttgagacaactgttgcattttggggtactaataaatgattgccgatgagttat

SEQ ID NO: 361472 - DNA, 1662 bp, Homo sapiens
gcggtgcgcgcgcctcgacatccgggcaacgcctctgttctgtcctcccccttcgtcgcctgtgacaaccggaagggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaatttaaatgcgactgtggtataaacagtaaaatgatttaaaagtaagtcattccgtttttattaatttactgttaagtcatgttctcatgctcagatcagtagtgtcagccagagctttctctgcagacatgtaggaagtgggtagctatttttcccactccatgtattagagttttacaaaaaggcttacttttgagacaactgttgcattttggggtactaataaatgattgccgatgagttat

SEQ ID NO: 361473 - DNA, 923 bp, Homo sapiens
gcggtgcgcgcgcctcgacatccgggcaacgcctctgttctgtcctcccccttcgtcgcctgtgacaaccggaagggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaagaaaaccaagagaagaaaagttcttaaggattctgctgaaagaagagagggactcttttgataactttctgtcctggcct

SEQ ID NO: 361474 - DNA, 1596 bp, Homo sapiens
gcggtgcgcgcgcctcgacatccgggcaacgcctctgttctgtcctcccccttcgtcgcctgtgacaaccggaagggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacacaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaatttacctagatgtctatttatgggattacttttgcagaatcataatttagcaaccatttatcatggatgaaagagatacctttgggagatgtacagcagaaaaaaaggagaaatgaagactggagaaacaaaatatgttatatatttgccaataattcacatgctgcctcagtgtcctcagatcccaggctgcacataaggtccatttgcctgagtattattacatacctccttctccagaaaactttcaagttcacagccttgcgttgtccatctttaatacacttagttgttggttttaataattaaggaaacaggacctacctatacctgtgccaacagggggcactatccctctgtaaagaacaaatcaaaaagtattttgtgttgtagctggaggatccaatggtcttgcttttggcaaaaacttgaagaggagggtggtctttacatgtgtggaaaccttgagtggccgagcaaatagcaagagaaattgcttagtggcttttaaaatttgaaatataattttactttttatttttacaatacagtgtacagtat

SEQ ID NO: 361475 - DNA, 1290 bp, Homo sapiens
gacacaggaaacttgagtagtcttaagttaaaaagctagaaagtagcaaatccagaatttaagtctaagcagtctaccttcagaatttttacaccctaacttttcctttctgtttcatctatatttcaaactttgggtatttaaagacattgggactgttctggagaagctgatatttaggaaatctggttgctgctcacagaataaaatcttaggttcagtgtaaattcagtaatgactggaaaaccaacaactcagttcacaagtactttaaaaataggtaactgtttaacatttcgtcttcccaacagcctgctgaactgtaaattctaccatctccactttgcagatgaggaaattgagactttgacaagtcaaagagcacagctggaatgcaagtcaagtatgatttgatttaatttgatctttatattttaagaattacgtactgcctttctaggaggcaaaaattagtttgaagtagggatccagattagtggttttccacatgtaggtaaattcaatgtaaagcaacaagccaaaggaccctagatttctcctgtggcttcttaaatacctggaatgtattggccttgttaaaatacttacaaaagtgcagatgactttatagtttagcatttgttaaaaagaaatcaagaaaacaatggacacataatttgttgtgtggagtcagttatctgaaacataggagaagaatatagatcaggaataggaatggaaagctgaactgtggtgacaggtgtatatatgtaagaaactttttgtttgttggtgtatgatttatgacctttgggagatgtacagcagaaaaaaaggagaaatgaagactggagaaacaaaatatgttatatatttgccaataattcacatgctgcctcagtgtcctcagatcccaggctgcacataaggtccatttgcctgagtattattacatacctccttctccagaaaactttcaagttcacagccttgcgttgtccatctttaatacacttagttgttggttttaataattaaggaaacaggacctacctatacctgtgccaacagggggcactatccctctgtaaagaacaaatcaaaaagtattttgtgttgtagctggaggatccaatggtcttgcttttggcaaaaacttgaagaggagggtggtctttacatgtgtggaaaccttgagtggccgagcaaatagcaagagaaattgcttagtggcttttaaaatttgaaatataattttactttttatttttacaatacagtgtacagtat

SEQ ID NO: 361476 - DNA, 586 bp, Homo sapiens
gcggtgcgcgcgcctcgacatccgggcaacgcctctgttctgtcctcccccttcgtcgcctgtgacaaccggaagggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagaggtagaatgaacttttcttagaatagtatttattttagaaaaatccagcatggcccttggcattttttttttgttgttgttattttaattaatttttttctttcaaaagtaaaaataccattataagtttaacaagtgtcaaatatcaaatagttcatttaataaaatccaaactctttaatcttgcctgca

SEQ ID NO: 361477 - DNA, 328 bp, Homo sapiens
ttgtcttggttctcaaatgttttctacaagtgcagtcttagtggagtcaagtgatcagggaatgattaggaagactttgtgcttacattattaatttgttcttattttagacttcttttgttactttggatgaagctattaagataaccaacaggcgtgtaaatgccattgaacatggtgagtattaggtactgtgaggtgctttgtcacttgtccataccctccacttgtcgtgaaactgctagaattcagggactgtactgaagactgaaagatgaataagatgcttcccttgcccacagtgcaaagagagaagtgtgtccatagt

SEQ ID NO: 361478 - DNA, 3193 bp, Homo sapiens
gcggtgcgcgcgcctcgacatccgggcaacgcctctgttctgtcctcccccttcgtcgcctgtgacaaccggaagggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaatttaaatgcgactgtggtataaacagtaaaatgatttaaaagtaagtcattccgtttttattaatttactgttaagtcatgttctcatgctcagatcagtagtgtcagccagagctttctctgcagacatgtaggaagtgggtagctatttttcccactccatgtattagagttttacaaaaaggcttacttttgagacaactgttgcattttggggtactaataaatgattgccgatgagttatgagggcattataatacttccttatttgctaattaagaaaataactagttcctattttagagtaagaaataaggtaactttttactatttataagtgataaaaacttgctttcatatatgaagatgaagcatttgagtggccacatcaggtgtctgaggtttttagtactgtttgatttggcatgagccatccatggggactcagtctttctcgcatccatttccaggcatttttgacatgattagccatggaataatgtttagttctgaaattgtgacactgtctttattaatactgtattttaatcaagtgacatcacagtccaggtagtttttctttcttttttttttttttgaaacagagtctcactcattctgtagcccaggctagagtgcagtggcagcaacatcagttcactgcaacgtccgcctcctcaattcaagagattctcctgcttcagtctcccgagtagctgggattacagcctgctgaactgtaaattctaccatctccactttgcagatgaggaaattgagactttgacaagtcaaagagcacagctggaatgcaagtcaagtatgatttgatttaatttgatctttatattttaagaattacgtactgcctttctaggaggcaaaaattagtttgaagtagggatccagattagtggttttccacatgtaggtaaattcaatgtaaagcaacaagccaaaggaccctagatttctcctgtggcttcttaaatacctggaatgtattggccttgttaaaatacttacaaaagtgcagatgactttatagtttagcatttgttaaaaagaaatcaagaaaacaatggacacataatttgttgtgtggagtcagttatctgaaacataggagaagaatatagatcaggaataggaatggaaagctgaactgtggtgacaggtgtatatatgtaagaaactttttgtttgttggtgtatgatttatgacctttgggagatgtacagcagaaaaaaaggagaaatgaagactggagaaacaaaatatgttatatatttgccaataattcacatgctgcctcagtgtcctcagatcccaggctgcacataaggtccatttgcctgagtattattacatacctccttctccagaaaactttcaagttcacagccttgcgttgtccatctttaatacacttagttgttggttttaataattaaggaaacaggacctacctatacctgtgccaacagggggcactatccctctgtaaagaacaaatcaaaaagtattttgtgttgtagctggaggatccaatggtcttgcttttggcaaaaacttgaagaggagggtggtctttacatgtgtggaaaccttgagtggccgagcaaatagcaagagaaattgcttagtggcttttaaaatttgaaatataattttactttttatttttacaatacagtgtacagtat

SEQ ID NO: 361479 - DNA, 2487 bp, Homo sapiens
gcggtgcgcgcgcctcgacatccgggcaacgcctctgttctgtcctcccccttcgtcgcctgtgacaaccggaagggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaatttaaatgcgactgtggtataaacagtaaaatgatttaaaagtaagtcattccgtttttattaatttactgttaagtcatgttctcatgctcagatcagtagtgtcagccagagctttctctgcagacatgtaggaagtgggtagctatttttcccactccatgtattagagttttacaaaaaggcttacttttgagacaactgttgcattttggggtactaataaatgattgccgatgagttatgagggcattataatacttccttatttgctaattaagaaaataactagttcctattttagagtaagaaataaggtaactttttactatttataagtgataaaaacttgctttcatatatgaagatgaagcatttgagtggccacatcaggtgtctgaggtttttagtactgtttgatttggcatgagccatccatggggactcagtctttctcgcatccatttccaggcatttttgacatgattagccatggaataatgtttagttctgaaattgtgacactgtctttattaatactgtattttaatcaagtgacatcacagtccaggtagtttttctttcttttttttttttttgaaacagagtctcactcattctgtagcccaggctagagtgcagtggcagcaacatcagttcactgcaacgtccgcctcctcaattcaagagattctcctgcttcagtctcccgagtagctgggattacagcctgctgaactgtaaattctaccatctccactttgcagatgaggaaattgagactttgacaagtcaaagagcacagctggaatgcaagtcaaatatgtacaaggatatccacaacactgttcgcagctacaagctgaggtacaaggtgcctcaaaagcttgagagaagcagaaatagaatagaatcctgacctgtgaaaacaatgactctgcaataaggtatgcaatttccaaaccacagctactagaaaaggtacactttaccttaccacat

SEQ ID NO: 361480 - DNA, 1900 bp, Homo sapiens
  misc_feature (1563)..(1563): n is a, c, g, or t
  misc_feature (1569)..(1569): n is a, c, g, or t
  misc_feature (1577)..(1577): n is a, c, g, or t
  misc_feature (1579)..(1579): n is a, c, g, or t
  misc_feature (1581)..(1581): n is a, c, g, or t
gcggtgcgcgcgcctcgacatccgggcaacgcctctgttctgtcctcccccttcgtcgcctgtgacaaccggaagggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaatttaaatgcgactgtggtataaacagtaaaatgatttaaaagtaagtcattccgtttttattaaaaaaaaaaaaaaanaaaaanaaaaaaanananaaaaaaaaaaaaaaaaaaaaaaaaaaaaaaaaaaaaggggggggggggaaaaaaaccccggggggggcttggcccccagttttttgtggaaaaggggccgccccatagaaggaggacttaatataagaaaagcgacggagggcgcccggataaaaccaagcgtgaggagggaaaaacacaacagagggatcctgggagggaccccctagttttgtgtgcggcacttatgggcaaaccacccaaagaagtacacgcgagggaaaaaaacaggggattgtgtcacacacaattcgcggaagaatgccggatagtaataggg

SEQ ID NO: 361481 - DNA, 1299 bp, Homo sapiens
gcggtgcgcgcgcctcgacatccgggcaacgcctctgttctgtcctcccccttcgtcgcctgtgacaaccggaagggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgttcctgtcttgtctgtcatgggagccattctgccaatttaaatgcgactgtggtataaacagtaaaatgatttaaaaagtctcactcattctgtagcccaggctagagttgcagtgagccaagatcacaccactgcactctaccctgggcaacagatggagattccatcttccaccttccaaaaaaaaaggtgcagagtttactaatttaaaacattgatatttcatatttatttaaataaaaatgattgaatttatt

SEQ ID NO: 361482 - DNA, 791 bp, Homo sapiens
  misc_feature (766)..(766): n is a, c, g, or t
gcggtgcgcgcgcctcgacatccgggcaacgcctctgttctgtcctcccccttcgtcgcctgtgacaaccggaagggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcantcactttaacgggatgctctagacg

SEQ ID NO: 361483 - DNA, 806 bp, Homo sapiens
gcggtgcgcgcgcctcgacatccgggcaacgcctctgttctgtcctcccccttcgtcgcctgtgacaaccggaagggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacacaaagcagtggaactactggtggaactagcttctctgcagacttcttttgttactttggatgaagctattaagataaccaacaggcgtgtaaatgccattgaacatgtcatccattcccccgggattggaacgttactccttggcttattatcatccaccagaaactgggaatgaagaagaagaagccgaagaaaggggttcctattagggtttaaaa

SEQ ID NO: 361484 - DNA, 345 bp, Homo sapiens
tttgaagcagttcaattaaatcttgttaagtatgacaataaattacttagtgattcctataaattctctaaaatacaagaaggagaaaattgaatatagcccaagtaagcagcagggatttttacagaaatgatttcttcaatcttgtctccatggttctgttgttattcttttataaaaggtctcaagaggaggagaaaaaaatataggagacaaaatatatatatatatattataaataagaagtctgcaagaagatcagagatttttgtggaaaatggggacggttcaataagcaaaatgaatttccttacacaatagctctgtattttgtgtagaaaatcg

SEQ ID NO: 361485 - DNA, 285 bp, Homo sapiens
taatcaattgtacatttcaaaataactagaagagaataatttgaatgtttctagcacgaagaaaagataacggttgggcaccatggctcatgcctgtaatcccaacattttgggaggctgaagtgagaggatcacttgagcccaggagttcaagaccagtctgagcaacatagtgagaccccatctctacaaaaaatttaaaaatcagccaggtatagcgtcatgaacctgtggttctctctgctcaagacgttgaggcaggaggatcacttgagcccaggagtt

SEQ ID NO: 361486 - DNA, 404 bp, Homo sapiens
tccaaaatgctagctggcacaatatgctaaaaacagcagaaattcactagcaaaaagcagaatttatttgttcttaaaaataacttgatgctctaaaaatatgaatttaagaagtgtcatcatggttcaaaatattttacatttcagtatgtaaacaccttaaaatatgtgactaatcttctaaaatggcgtaatttccaaataacaggaaatattccaagagaaaaatagaaggcttttaaaatcaatttttttagttttgaggtatttactgaatgaaaagctacaatgtatatttacttttttttcccctactgctgccctgaatcactgtttaaaatgtgggcaaaaagacataggctttgttggaatttctcagagagtttactgtagaaaatgctaaa

SEQ ID NO: 361487 - DNA, 786 bp, Homo sapiens
ggacaagtagacccattacagagaagacgacgcgcagaaaaggaggaagcagtgtgctcatggaggcggagattggagtgatgtaaccgcaagccgaggaatgcttatagtcaccagaagctggaagagtcaaaggacacattctcccctcaagccccagtgggagcacggcccagctggattttggacttctggcctccagaactgtaagagaaatgtccattgtcttaagccaaccagtttgtggtagtttgttacagcagccccaggaaactactatgcagtcaaaagtcttcagtaaaccaaaaatctctaattatcgttgttttatatcatgtgctatgacgatcagagactaaacagctctttcgttagaattctaattctgagaaatatcagaggaagtgttttaataccctccagtctcaacaggaatcgattatatcttataagatacattttgttattttgcttgtatcgtttctttcttctcctaacttgctccttctttgctctttgtatactttttaagatgtagttgacatgggggaggggaatgagtaaaacactagtaggatagaccaacaggttttgtcttctttaaagtgtaatttctccatgatcccccttccaccttttctgtctcctttactggattcgcctcttctcccctacatcttaatgttgggatgctacagacctcattccctactctttaatatttactttttggtgatttcatctgtgttcacgattttacataccatccaaataacagcaactcca

SEQ ID NO: 361488 - DNA, 235 bp, Homo sapiens
gcggccgcctactactactactgctcgaattcaagcttctaacgatgtacggggaatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgttaaataaatgtaaatactaatgta

SEQ ID NO: 361489 - DNA, 4345 bp, Homo sapiens
aggtggtagttgcggcgctggttcccgggagcagccgtcgagccacaactgcggaggaggagttcgggaaagcggccgtcgggactcctcccctccgtcgtctccgccccggttgagaggcgcctcggcgcatcggagggaccctcccccgcgcttcctcaggctgctgtcgccgctgctgggagatgggcctactcgcccgccaccctgcgctgccgccgctctgaggagttaaagttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgttaaataaatgtaaatactaatgta

SEQ ID NO: 361490 - DNA, 4336 bp, Homo sapiens
tgcctgtctactgccgagggcatttgagtgtgggacccatgccctgcatttcttcgctaccccacagcttctgctcatgaatccagctcaaatgtcagaagaattgacgttagtttgagagaccaaactaagttacagcctctttggtttctgttactctggctggtcttgaactcctggactcaagtgatccaaccacctctgcttctcaaagtgctaggactacagttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgttaaataaatgtaaatactaatgta

SEQ ID NO: 361491 - DNA, 4315 bp, Homo sapiens
ccctcgagctgtctcctgcccctaaagcgggggagacccaagggcggttgccgcggggaggcggcgggggcggaacgcattcctgacgggtgaaatcggctctaacgggaccgatttccgggcctcgctgcaaatttggagccgggacatcgccccgcaagccgtgctgcctggggccttagggaggggagctgtgttcggaggaagttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgttaaataaatgtaaatactaatgta

SEQ ID NO: 361492 - DNA, 4166 bp, Homo sapiens
tgatgagtacacggagtccattttagttttatttgtgataataactttgtgagctctgttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgttaaataaatgtaaatactaatgta

SEQ ID NO: 361493 - DNA, 4763 bp, Homo sapiens
  misc_feature (221)..(221): n is a, c, g, or t
  misc_feature (4763)..(4763): n is a, c, g, or t
ggacaagtagacccattacagagaagacgacgcgcagaaaaggaggaagcagtgtgctcatggaggcggagattggagtgatgtaaccgcaagccgaggaatgcttatagtcaccagaagctggaagagtcaaaggacacattctcccctcaagccccagtgggagcacggcccagctggattttggacttctggcctccagaactagacagggcctcacngtgtcacccagggtggaatacagtggtgtgatcatagctcactgcagcctggaattcctgggctcaagcaaccctgccacctcagccttccaagtagctaggactacagttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgttaaataaatgtaaatactaatgtaaaaaaaaaaaaaaaaaaaaaaaaaaaaatttttgggcggcctgtggtgccctcagaaaaatgtgttttagaacccaattcggtttgtgaggcgcggcccacagtaggtgtaagtgacacacaggtgcaccataagggtgttccctacagaaagaactcctgggccatggacctagtggcgggggattctcacccaaattaaaaaaaaagcgcggggggggaaccacggaaggttctttggaaccaaatccagagggggtccgagaggcaacacggggctctacacggggggcccagcaagctgaatataatccgcggcggggagn

SEQ ID NO: 361494 - DNA, 4398 bp, Homo sapiens
  misc_feature (221)..(221): n is a, c, g, or t
ggacaagtagacccattacagagaagacgacgcgcagaaaaggaggaagcagtgtgctcatggaggcggagattggagtgatgtaaccgcaagccgaggaatgcttatagtcaccagaagctggaagagtcaaaggacacattctcccctcaagccccagtgggagcacggcccagctggattttggacttctggcctccagaactagacagggcctcacngtgtcacccagggtggaatacagtggtgtgatcatagctcactgcagcctggaattcctgggctcaagcaaccctgccacctcagccttccaagtagctaggactacagttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccccattaatatgcttataacactagtgccagttattttatttgataatgcttatggtatttgtatatttgtttgcattccaattttgtttaataatgagtgtgtaaactgcatacgttaaataaatgtaaatactaatgta

SEQ ID NO: 361495 - DNA, 4161 bp, Homo sapiens
  misc_feature (221)..(221): n is a, c, g, or t
ggacaagtagacccattacagagaagacgacgcgcagaaaaggaggaagcagtgtgctcatggaggcggagattggagtgatgtaaccgcaagccgaggaatgcttatagtcaccagaagctggaagagtcaaaggacacattctcccctcaagccccagtgggagcacggcccagctggattttggacttctggcctccagaactagacagggcctcacngtgtcacccagggtggaatacagtggtgtgatcatagctcactgcagcctggaattcctgggctcaagcaaccctgccacctcagccttccaagtagctaggactacagttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctc

SEQ ID NO: 361496 - DNA, 894 bp, Homo sapiens
tcactgagcgacgcccatacgtcgatgctactgagtatgcaagatctatcgtccacggcgcatgaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgttaaataaatgtaaatactaatgta

SEQ ID NO: 361497 - DNA, 554 bp, Homo sapiens
ggctagaggatccccaagcagttaatacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgttaaataaatgtaaatactaatgta

SEQ ID NO: 361498 - DNA, 3657 bp, Homo sapiens
  misc_feature (221)..(221): n is a, c, g, or t
ggacaagtagacccattacagagaagacgacgcgcagaaaaggaggaagcagtgtgctcatggaggcggagattggagtgatgtaaccgcaagccgaggaatgcttatagtcaccagaagctggaagagtcaaaggacacattctcccctcaagccccagtgggagcacggcccagctggattttggacttctggcctccagaactagacagggcctcacngtgtcacccagggtggaatacagtggtgtgatcatagctcactgcagcctggaattcctgggctcaagcaaccctgccacctcagccttccaagtagctaggactacagttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagctatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgttaaataaatgtaaatactaatgta

SEQ ID NO: 361499 - DNA, 1808 bp, Homo sapiens
  misc_feature (221)..(221): n is a, c, g, or t
ggacaagtagacccattacagagaagacgacgcgcagaaaaggaggaagcagtgtgctcatggaggcggagattggagtgatgtaaccgcaagccgaggaatgcttatagtcaccagaagctggaagagtcaaaggacacattctcccctcaagccccagtgggagcacggcccagctggattttggacttctggcctccagaactagacagggcctcacngtgtcacccagggtggaatacagtggtgtgatcatagctcactgcagcctggaattcctgggctcaagcaaccctgccacctcagccttccaagtagctaggactacagttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaaggtaaaatgcatacttcttgttagtccattatcttattctaaatctttaggtgtattcttttagtattgatgatttttgggtttttttttttttttttttagacaaagggtatctttagtttcttcagtataaaacagttactcttttttcataaatttttagtgtttggcaagcatatataaata

SEQ ID NO: 361500 - DNA, 425 bp, Homo sapiens
  misc_feature (388)..(388): n is a, c, g, or t
  misc_feature (390)..(390): n is a, c, g, or t
  misc_feature (393)..(394): n is a, c, g, or t
taatggttaagaaacatacttgtttgaaatttcatatttataaaaatatacaaactaagaatacaattaaatgatcttgatttttttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaatnanggnnagtttttggggggggtgggtaggcagaatta

SEQ ID NO: 361501 - DNA, 448 bp, Homo sapiens
taatggttaagaaacatacttgtttgaaatttcatatttataaaaatatacaaactaagaatacaattaaatgatcttgatttttttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaattgtacccatcagggtgccgtggaaggcgggctttctcttttcttacttaggacatattata

SEQ ID NO: 361502 - DNA, 456 bp, Homo sapiens
  misc_feature (405)..(405): n is a, c, g, or t
taatggttaagaaacatacttgtttgaaatttcatatttataaaaatatacaaactaagaatacaattaaatgatcttgatttttttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaatctaaaggtcgcctcagancctttctctctcctgtggtggctggtcgggctgtgtgccgataatatccgt

SEQ ID NO: 361503 - DNA, 454 bp, Homo sapiens
  misc_feature (403)..(403): n is a, c, g, or t
taatggttaagaaacatacttgtttgaaatttcatatttataaaaatatacaaactaagaatacaattaaatgatcttgatttttttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaatgtccaacccaaaaagntcttcgtgagtcacaaacagggtttgttggtgtttgggattgttactggcg

SEQ ID NO: 361504 - DNA, 438 bp, Homo sapiens
  misc_feature (397)..(397): n is a, c, g, or t
  misc_feature (401)..(401): n is a, c, g, or t
taatggttaagaaacatacttgtttgaaatttcatatttataaaaatatacaaactaagaatacaattaaatgatcttgatttttttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaatggtattgttntccnttgagagggttctttggctgcaaggtaataagtggta

SEQ ID NO: 361505 - DNA, 385 bp, Homo sapiens
cccagagcttacgtttgagaactatacgttcttcatccattagttatagtcaagagtctggagcagcaggtatttatgtctaattttttctaataaaatatttgacacaaaacactagttattttaactttttaaagttaagtattcctgttttcctttcacttgccgaaagtgtttttaagtgcatttctatcccagaagcactcattctttcctatggaagaaagtggttctgaaattagaaagattatactgtccaggaaaaaaggaagtgttgtgatgatttatataactgatagccaaagatagtctgaaactgttgattataaaggtatctgtccaggtatggtagctcactcctgtaatcccagtactttgggaggct

SEQ ID NO: 361506 - DNA, 4438 bp, Homo sapiens
  misc_feature (221)..(221): n is a, c, g, or t
ggacaagtagacccattacagagaagacgacgcgcagaaaaggaggaagcagtgtgctcatggaggcggagattggagtgatgtaaccgcaagccgaggaatgcttatagtcaccagaagctggaagagtcaaaggacacattctcccctcaagccccagtgggagcacggcccagctggattttggacttctggcctccagaactagacagggcctcacngtgtcacccagggtggaatacagtggtgtgatcatagctcactgcagcctggaattcctgggctcaagcaaccctgccacctcagccttccaagtagctaggactacagttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgttaaataaatgtaaatactaatgta

SEQ ID NO: 361507 - DNA, 4193 bp, Homo sapiens
taatggttaagaaacatacttgtttgaaatttcatatttataaaaatatacaaactaagaatacaattaaatgatcttgatttttttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgttaaataaatgtaaatactaatgta

SEQ ID NO: 361508 - DNA, 4314 bp, Homo sapiens
ggacaagtagacccattacagagaagacgacgcgcagaaaaggaggaagcagtgtgctcatggaggcggagattggagtgatgtaaccgcaagccgaggaatgcttatagtcaccagaagctggaagagtcaaaggacacattctcccctcaagccccagtgggagcacggcccagctggattttggacttctggcctccagaactttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgttaaataaatgtaaatactaatgta

SEQ ID NO: 361509 - DNA, 4243 bp, Homo sapiens
tcctaattttcccccccctgaaaggaaacggccccaaaactccacccttgaggcccactaggcccttttttttatttttgggggttttcgtgtttttttgcgccgttgattagattctttattttttttgtttttttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgttaaataaatgtaaatactaatgta

SEQ ID NO: 361510 - DNA, 4224 bp, Homo sapiens
  misc_feature (221)..(221): n is a, c, g, or t
ggacaagtagacccattacagagaagacgacgcgcagaaaaggaggaagcagtgtgctcatggaggcggagattggagtgatgtaaccgcaagccgaggaatgcttatagtcaccagaagctggaagagtcaaaggacacattctcccctcaagccccagtgggagcacggcccagctggattttggacttctggcctccagaactagacagggcctcacngtgtcacccagggtggaatacagtggtgtgatcatagctcactgcagcctggaattcctgggctcaagcaaccctgccacctcagccttccaagtagctaggactacagttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgttaaataaatgtaaatactaatgta

SEQ ID NO: 361511 - DNA, 4480 bp, Homo sapiens
  misc_feature (221)..(221): n is a, c, g, or t
ggacaagtagacccattacagagaagacgacgcgcagaaaaggaggaagcagtgtgctcatggaggcggagattggagtgatgtaaccgcaagccgaggaatgcttatagtcaccagaagctggaagagtcaaaggacacattctcccctcaagccccagtgggagcacggcccagctggattttggacttctggcctccagaactagacagggcctcacngtgtcacccagggtggaatacagtggtgtgatcatagctcactgcagcctggaattcctgggctcaagcaaccctgccacctcagccttccaagtagctaggactacagttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcacttttccctaccaggtccattaatatgcttataacactagtgccagttattttatttgataatgcttatggtatttgtatatttgtttaagtgaattatacaggaaattaacagtacaggcagtattttggccaacttctgcttatgtcagctgaacattgtccataaacaaaagcaaaagaaaataatgcgtcgacg

SEQ ID NO: 361512 - DNA, 2552 bp, Homo sapiens
  misc_feature (221)..(221): n is a, c, g, or t
ggacaagtagacccattacagagaagacgacgcgcagaaaaggaggaagcagtgtgctcatggaggcggagattggagtgatgtaaccgcaagccgaggaatgcttatagtcaccagaagctggaagagtcaaaggacacattctcccctcaagccccagtgggagcacggcccagctggattttggacttctggcctccagaactagacagggcctcacngtgtcacccagggtggaatacagtggtgtgatcatagctcactgcagcctggaattcctgggctcaagcaaccctgccacctcagccttccaagtagctaggactacagttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacagtggaagtacaagcagatgtacagaaagaggctgctgtcgccgctgctgggagatgggcctactcgcccgccaccctgcgctgccgccgctctgaggagttaaagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacaccggcaaatgggttcagatcgagatcttcagtcctctgcttcatctgtgagcttgccttcagtcaaaaaggcagccaaaaaaagaagaatttcaataggttccccagaggccccgttcccggtactaccttaatatt

SEQ ID NO: 361513 - DNA, 2334 bp, Homo sapiens
  misc_feature (221)..(221): n is a, c, g, or t
ggacaagtagacccattacagagaagacgacgcgcagaaaaggaggaagcagtgtgctcatggaggcggagattggagtgatgtaaccgcaagccgaggaatgcttatagtcaccagaagctggaagagtcaaaggacacattctcccctcaagccccagtgggagcacggcccagctggattttggacttctggcctccagaactagacagggcctcacngtgtcacccagggtggaatacagtggtgtgatcatagctcactgcagcctggaattcctgggctcaagcaaccctgccacctcagccttccaagtagctaggactacagttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaagagcagctgagatcgatgacaagctcaacaaaattaacgatcgttggcaacatctttttgatgtcatcggatcaagggtgaagaagctgaaggagacctttgcttttattcagcag

SEQ ID NO: 361514 - DNA, 1448 bp, Homo sapiens
  misc_feature (221)..(221): n is a, c, g, or t
ggacaagtagacccattacagagaagacgacgcgcagaaaaggaggaagcagtgtgctcatggaggcggagattggagtgatgtaaccgcaagccgaggaatgcttatagtcaccagaagctggaagagtcaaaggacacattctcccctcaagccccagtgggagcacggcccagctggattttggacttctggcctccagaactagacagggcctcacngtgtcacccagggtggaatacagtggtgtgatcatagctcactgcagcctggaattcctgggctcaagcaaccctgccacctcagccttccaagtagctaggactacagttttttcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtgggtaagaagataatgtttgatttttcttgagttaatttttttctctgtggataaaataatttgctattactcaaaagaaaaatttttacatgctggagaattcattcaacagacatgttgagtgcacaccatatgtcaggcactatgctaggtgttaaaggcagtgatcctatcttactcatttctatatcgtctctgcgttacatactcactgagcacttttagaaggaaagggtaaggtggtagagtacaggatctagttgtatacaaaattggttttctcatccatttggagaatttttattttggaataacagatgaaatgatcaggtttgtttatgat

SEQ ID NO: 361515 - DNA, 602 bp, Homo sapiens
tgggtagaagcctaactttgatgggcaccaattagcaaatgccaatggcccaatcacagagaaaaatatttgcaaactcaggaacaacttaatgtgcttgacatatcccactgataagcctgccccttaactataaatccttcagtacttttctaactcgccgttgtgcttaaaccctcctcatggtatgacttacctccttcttcttatcaatttctcagttaccatgaggcaattattgtagcaacaacacacaaatgtatacacaagtgtcctaaggataaatattctcagacacagtaaagttgaaatgagaggcttcaaatctatgacctactgcccagatatgcatacaaaacacacataattggaggaggtgaagcaagatggtggaacagaaggctccacccattgttccccacccaaggacaccaagttaacaactatctacagagaaaaaacacctttgtatgcttttaggctgggcgcggtggctcatgcctgtagtcctggcattttgggaggctgaggcagaaggattacttgaggccaggagttcaagaccagcctaggcaacatggtgggacccacgtctctaccag

SEQ ID NO: 361516 - DNA, 343 bp, Homo sapiens
agaagtgacagcactgaagtgagattctgcagaatgttaatgaagttacagaagaaatagctgactgtgggaatgtgcagtgaagaaatttactgaaagtcaacttactgatataaatgaggaaagtcattgtgaggaaaaggatgaagatgtcccagaggaagtggtgcctcacaaacactttgtattagagaaacttgcagagagattttaccacattgaaggagcaaaggattcaatgttggaagttgatccatacttagcagggagtacaacagtttgctaaggcaaagaaaagatgttcacattgtgtcagaaattatatgacaagaagaaggcaagc

SEQ ID NO: 361517 - DNA, 2149 bp, Homo sapiens
ctagggtagcacagcctgtcattgggagtttccagacagaagtgttcccattccttactcctaaaggtggacttgaggagggtctttgaaagtcagctagaccaatctctagttgaacctcaaggagagtgaggtacagagcagagactgctggcttccaggtctagctggctcccacttggcctggccagagaattggtctgatggtgcccacaccttcaccggaggccctttggtgaccccatgcatgtttcctttgcaggacaagattagatgcaccccggttggaaacaaagtccctgagcagctccgtgttaccacccagctatgcttcagatcgcctgtcaggaaacaacagggaccctgctctgaaacccaagcggtcccaccgcaaggcagaccctgatgctgcccacaggccacggatcctggagatggacaaggaagagaaccggcgctcggtgctgctgcccacacaccggcggaggggtagcttcagctctgagaactactggcgcaagtcatacgagtcctcagaggactgctctgaggcagcaggcagccctgcccgaaaggtgaagatgcggcggcactgagtctacccgccgccctcctgggaactctggctcatccttacgtagttgcccctccttttgttttgagggttttgtttttgttcattggggggtttttgttttttgttttttgttttttttgattctatatatttttccttggttttgttgcctgttaaggctgaagaatagaattggccaggacctaggttctcatattcttggtattcctcctggatggaaaggctgttggcatcaataggggacagaggctgatgctggagtggccagtagaggtggtggagcagagcagccatcttttaagtggggctgtatcaggctgggtttatttaaaagcaacaaaatgttttggttaagaaaattattttgctttcagtgtaaatcttcgcagtgttctaaacaaagttcagtcttctgctcgcccctttccctcactgatgtctgcacttggttgaggtctcctggagcctcacaggctctgctgttctccacttctcacctgccatccacgccctgcaagctcatgcaaacaccctttcttcctcctgcggcagagttgttcaggttgcctgggcaggggcttaaacagtgccagcccctgccatcccaaagctattgttaagccccccaggcgtcctccacccacgcccactagcctgccatgtccacagttccttgggctgctgaggggctagtgcagtggtcctgacctctcttatcaagagcacacttctttgctggttgctccttttgagcatatgcgtgtgattatttggaacagttagacttgccacgttgggtcagttttagaaattgtttctagctagagggactggtgtccttccaagtctagcatttggggtatggaaaattgttgtggtgtgtggtagggtttttgttttcttttttgagttttttttccccctttagtctcctggctttttcctttcccttcccttctccactggccagcttgggcctcatcctcatgtcatccttctaggaaggcgcctgccccatcttgtctgccggcagcatgcatccaaggccagagctcaggcctgcagactgggctggtgcctcctccgcttcagggtatgggagttggtgaaggggctttcaaaaaataataagaaaaaaaaggtaaagtctttggtagcttctatccactcagatcctggaaggcagcaaggttttgtggatctagattcattaggaatgtcttcttgtcagccaggccaggacccgggcttgccaagagcagaggccctcccagcaaccaggataccaccactttgggggctttgtgtacagaggtccgggtctgagacctcataggctgcagaaatctggggcagccaccatcaagaagcccctctcaggggccagaactcctttgccagcgtggatttctcaagtcgggactgcataattaaagcagttgcagttttattttttttacagcttttttcccaaaaatgatttgtagttgtgtgtgcagcacttcgccctgatatgtgtgctctacaataaaaaccaaatctaatatattt

SEQ ID NO: 361518 - DNA, 424 bp, Homo sapiens
tttgcttaagagagaagtaaacatatctatttatttagttcaacagcctggagcagctgtgcatcaacttcaccaatgagaaactgcaacagtttttcaaccaccacatgttcgtgctggagcaggaggagtacaagaaggaaggcatcgagtggacgttcatcgacttcgggatggacctggctgcctgcatcgagctcatcgagaaggttggtctgatgctattcctgtccctttgaactttattaaagcttgtgatttgcaactctttccattcacaggtctttttcaaagctggtcttctggggctcctagaggagatgcgagatgacaagctggcccagctgattacccgaacccaggccaggtgcagagggttcaaggtatatcgttatttatttacacctgatccaagtaccttctg

SEQ ID NO: 361519 - DNA, 6105 bp, Homo sapiens
gaggacgggcctttcaagagggacactggtcacaccgcccagtgtcagcagcagctgctagttctgaactgtctcactcccaggctacatcttctcacttgctaacaaggacctctgagttcagcagccatgagttcagactcagaattggctgtttttggggaggctgctcctttcctccgaaagtctgaaagggagcgcattgaggcccagaataggccctttgatgccaaaacatctgtctttgtggcggagcccaaagaatcctttgtcaaagggaccatccagagcagagaaggaggaaaagtgacggtgaagactgagggaggagcgactctgacagtgaaggatgatcaggtcttccccatgaaccctcccaaatatgacaagatcgaggatatggccatgatgactcatctgcatgagcctgctgtgctgtacaacctcaaagaacgttatgcagcctggatgatctacacctattcaggtctcttctgtgtcactgtcaacccctacaagtggctgcctgtgtataagcccgaggtggtgacagcctaccgaggcaaaaagcgccaggaggccccgccccacatcttctccatctctgacaacgcctatcagttcatgctgactgaccgagagaatcagtcaatcctgatcactggagaatctggtgcagggaagactgtgaacaccaagcgtgtcatccagtactttgcaacaattgcagttactggtgagaagaagaaggaagaaattacttctggcaaaatacaggggactctggaagatcaaatcatcagtgccaaccccctactggaggcctttggcaacgccaagaccgtgaggaatgacaactcctctcgctttggtaaattcatcagaatccactttggcactactggaaaactggcatctgctgatattgaaacatatctgctagagaagtctagagttgttttccagcttaaggctgagagaagttatcatattttttaccagattacatcgaataagaaaccagaacttattgaaatgcttctgattaccacgaacccatatgattacccatttgtcagtcaaggggagatcagtgtggccagcatcgatgatcaggaagaactgatggccacagatagtgctattgatattttgggctttactaatgaagaaaaggtctccatttacaagctcacgggggctgtgatgcattatgggaacctaaaatttaagcaaaagcagcgtgaggagcaagcagagccagatggcacagaagttgctgacaaggcggcctacctccagagtctgaactctgcagatctgctcaaagctctctgctaccccagggtcaaggtcggcaatgagtatgtcaccaaaggccagactgtagaacaggtgtccaacgcagtaggtgctctggccaaagccgtctacgagaagatgttcctgtggatggttgcccgcatcaaccagcagctggacaccaagcagcccaggcagtacttcatcggggtcttggacattgctggttttgagatttttgatttcaacagcctggagcagctgtgcatcaacttcaccaatgagaaactgcaacagtttttcaaccaccacatgttcgtgctggagcaggaggagtacaagaaggaaggcatcgagtggacgttcatcgacttcgggatggacctggctgcctgcatcgagctcatcgagaaggttggtcctatgggcatcttctccatcctggaagaggagtgcatgttccctaaggcaacagacacctccttcaagaacaagctgtatgaccagcacctgggcaagtctgccaacttccagaagcccaaggtggtcaaaggcaaggccgaggcccacttcgctctgattcactatgctggtgttgtggactacaacattactggctggctggagaagaacaaggaccccctgaatgagaccgtggttggactgtaccagaagtctgcaatgaaaactctagctcagctcttctctggggctcaaactgctgaaggagagggagctggtggaggggccaagaaaggtggtaagaagaagggctcttctttccagacagtgtctgcccttttcagagagaatttgaacaagctgatgaccaacctcaggagtacccatcctcactttgtgaggtgtatcatccccaatgagacaaaaactcctggtgccatggagcatgagcttgtcctccaccagctgaggtgtaacggtgtgctggaaggcatccgcatctgtaggaaaggatttccaagcagaatcctttatgcagacttcaaacagagatacaaggtattaaatgcaagtgcaatccctgaagggcaattcattgatagcaagaaggcctctgagaagctccttgcatccatcgacattgaccacacccagtataaatttgggcacaccaaggtctttttcaaagctggtcttctggggctcctagaggagatgcgagatgacaagctggcccagctgattacccgaacccaggccaggtgcagagggttcttggcaagagtggagtaccagaggatggtggagagaagggaggccatcttctgtatccagtacaatatcagatccttcatgaatgtcaagcactggccctggatgaaactcttcttcaagatcaagcctctgttgaagagtgcagaaactgagaaggagatggccaccatgaaggaagaatttcagaaaattaaagacgaacttgccaagtcagaggcaaaaaggaaggaactggaagaaaagatggtgacgctgttgaaagaaaaaaatgacttgcagctccaagttcaggctgaagccgaaggcttggctgatgcagaggaaaggtgtgaccagctaatcaaaaccaaaatccagctagaagccaaaatcaaagaggtgactgagagagctgaggatgaggaagagatcaatgctgagctgacagccaagaagaggaaactggaggatgaatgttcagaactcaagaaagacattgatgaccttgagctgacactggccaaggttgagaaggagaaacatgccacagaaaacaaggtgaaaaacctcacagaagagatggcaggtctggatgaaaccattgctaagctgaccaaggagaagaaggctctccaggaggcccaccagcagaccctggatgacctgcaggcagaggaggacaaagtcaacaccctgaccaaagctaaaatcaaacttgaacaacaagtggatgatcttgaagggtccttggagcaagaaaagaaacttcgcatggacctagaaagggctaagaggaaacttgagggtgacttgaagttggcccaagaatccataatggacattgaaaatgagaaacagcaacttgatgaaaagctcaaaaagaaagagtttgaaatcagcaatctgcaaagcaagattgaagatgaacaggcacttggcattcaattgcagaagaaaattaaagaattgcaagcccgcattgaggagctggaggaggaaatcgaggcggagcgggcctcccgggccaaagcagagaagcagcgctctgacctctcccgggagctggaggagatcagcgagaggctggaagaagccggtggggccacttcagcccagattgagatgaacaagaagcgggaggctgagttccagaaaatgcgcagggacctggaggaggccaccctacagcatgaagccacagcggccaccctgaggaagaagcatgcagatagtgtggccgagcttggggagcagattgacaacctgcagcgagtgaagcagaagctggagaaggagaagagtgagatgaagatggagattgatgaccttgctagtaatgtagaaacggtctccaaagccaagggaaacctagagaaaatgtgccggactctagaggaccaactgagtgaactgaaatcaaaggaagaggagcagcagcggctgatcaatgacctgactgcgcagagggggcgcctgcagactgaatctggtgagttttcacgccagcttgatgaaaaggaagctctggtgtctcagttatcaagaggcaaacaagcctttactcaacagattgaagaattaaagaggcaacttgaagaggagataaaagccaagaacgccctggcgcatgccctgcagtcttcccgccacgactgtgacctgctgcgggaacagtatgaggaggagcaggaatccaaggccgagctgcagagagcactgtccaaggccaacaccgaggttgcccaatggaggaccaaatacgagacggacgccatccagcgcacagaggagctggaggaggccaagaagaagctggcccagcggctgcaggcagctgaggaacatgtagaagctgtgaacgccaaatgtgcttccctcgaaaagacgaagcagcggctgcagaatgaggtcgaggacctcatgcttgatgtggagaggacaaatgccgcctgtgccgcccttgacaaaaagcaaaggaacttcgataagatcctggcagaatggaaacagaaatgtgaggaaacgcatgctgagcttgaggcctcccagaaggaagcccgttcccttggcactgagctgttcaagataaagaatgcctatgaggaatctttggatcagctagaaaccctgaagcgagagaacaaaaacttacagcaggagatttctgacctcacggaacagattgcagaaggagggaaacgtatccatgaactggagaaaataaagaaacaagtggaacaagaaaagtgtgaacttcaggctgctttagaagaagcagaggcatctcttgaacatgaagagggaaagatcctgcgcatccagcttgagttgaaccaagtcaagtctgaggttgataggaaaattgctgaaaaagatgaggaaattgaccagctgaagagaaaccacattagaatcgtggagtccatgcagagcacgctggatgctgagatcaggagtaggaatgatgccattaggctcaagaagaagatggagggagacctcaatgaaatggaaatccagctgaaccatgccaaccgcatggctgctgaggccctgaggaactacaggaacacccaaggcatcctcaaggatacccagatccacctggatgatgctctccggagccaggaggacctgaaggaacagctggccatggtggagcgcagagccaacctgctgcaggctgagatcgaggagctgcgggccactctggaacagacagagaggagcagaaaaatcgcagaacaggagctcctggatgccagtgagcgtgttcagctactgcacacccagaacaccagcctgatcaacaccaagaagaagctggagacagatatttcccaaatgcaaggagagatggaggacattctccaggaagcccgcaatgcagaagaaaaggccaagaaggccatcactgatgccgccatgatggctgaggagctgaagaaggagcaggacaccagcgcccacctggagcggatgaagaagaacatggagcagaccgtgaaggatctgcagctccgtctggatgaggctgagcagctggccctgaagggtgggaagaagcagatccagaaactggaggccagggtacgggagctggaaggagaggttgagagtgagcaaaagcgtaatgctgaggctgtcaaaggtctgcgcaaacatgagaggcgagtgaaggaactcacttaccagacggaagaagatagaaagaatattctcaggcttcaagatttggtagataaacttcaggcaaaagtgaaatcttataagagacaagctgaggaggctgaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgcaaacaataaaaaaaaaaaag

SEQ ID NO: 361520 - DNA, 3232 bp, Homo sapiens
catggcggccgccagcggctacacggacctgcgtgagaagctcaagtccatgacgtcccgggacaactataaggcgggcagccgggaggccgccgccgctgccgcagccgccgtagccgccgcagccgcagccgccgctgccgccgaaccttaccctgtgtccggggccaagcgcaagtatcaggaggactcggaccccgagcgcagcgactatgaggagcagcagctgcagaaggaggaggaggcgcgcaaggtgaagagcggcatccgccagatgcgcctcttcagccaggacgagtgcgccaagatcgaggcccgcattgacgaggtggtgtcccgcgctgagaagggcctgtacaacgagcacacggtggaccgggccccactgcgcaacaagtacttcttcggcgaaggctacacttacggcgcccagctgcagaagcgcgggcccggccaggagcgcctctacccgccgggcgacgtggacgagatccccgagtgggtgcaccagctggtgatccaaaagctggtggagcaccgcgtcatccccgagggcttcgtcaacagcgccgtcatcaacgactaccagcccggcggctgcatcgtgtctcacgtggaccccatccacatcttcgagcgccccatcgtgtccgtgtccttctttagcgactctgcgctgtgcttcggctgcaagttccagttcaagcctattcgggtgtcggaaccagtgctttccctgccggtgcgcaggggaagcgtgactgtgctcagtggatatgctgctgatgaaatcactcactgcatacggcctcaggacatcaaggagcgccgagcagtcatcatcctcaggaagacaagattagatgcaccccggttggaaacaaagtccctgagcagctccgtgttaccacccagctatgcttcagatcgcctgtcaggaaacaacagggaccctgctctgaaacccaagcggtcccaccgcaaggcagaccctgatgctgcccacaggccacggatcctggagatggacaaggaagagaaccggcgctcggtgctgctgcccacacaccggcggaggggtagcttcagctctgagaactactggcgcaagtcatacgagtcctcagaggactgctctgaggcagcaggcagccctgcccgaaaggtgaagatgcggcggcactgagtctacccgccgccctcctgggaactctggctcatccttacgtagttgcccctccttttgttttgagggttttgtttttgttcattggggggtttttgttttttgttttttgttttttttgattctatatatttttccttggttttgttgcctgttaaggctgaagaatagaattggccaggacctaggttctcatattcttggtattcctcctggatggaaaggctgttggcatcaataggggacagaggctgatgctggagtggccagtagaggtggtggagcagagcagccatcttttaagtggggctgtatcaggctgggtttatttaaaagcaacaaaatgttttggttaagaaaattattttgctttcagtgtaaatcttcgcagtgttctaaacaaagttcagtcttctgctcgcccctttccctcactgatgtctgcacttggttgaggtctcctggagcctcacaggctctgctgttctccacttctcacctgccatccacgccctgcaagctcatgcaaacaccctttcttcctcctgcggcagagttgttcaggttgcctgggcaggggcttaaacagtgccagcccctgccatcccaaagctattgttaagccccccaggcgtcctccacccacgcccactagcctgccatgtccacagttccttgggctgctgaggggctagtgcagtggtcctgacctctcttatcaagagcacacttctttgctggttgctccttttgagcatatgcgtgtgattatttggaacagttagacttgccacgttgggtcagttttagaaattgtttctagctagagggactggtgtccttccaagtctagcatttggggtatggaaaattgttgtggtgtgtggtagggtttttgttttcttttttgagttttttttccccctttagtctcctggctttttcctttcccttcccttctccactggccagcttgggcctcatcctcatgtcatccttctaggaaggcgcctgccccatcttgtctgccggcagcatgcatccaaggccagagctcaggcctgcagactgggctggtgcctcctccgcttcagggtatgggagttggtgaaggggctttcaaaaaataataagaaaaaaaaggtaaagtctttggtagcttctatccactcagatcctggaaggcagcaaggttttgtggatctagattcattaggaatgtcttcttgtcagccaggccaggacccgggcttgccaagagcagaggccctcccagcaaccaggataccaccactttgggggctttgtgtacagaggtccgggtctgagacctcataggctgcttgagattattcagctaggaaggccatcactgatgccgccatgatggctgaggagctgaagaaggagcaggacaccagcgcccacctggagcggatgaagaagaacatggagcagaccgtgaaggatctgcagctccgtctggatgaggctgagcagctggccctgaagggtgggaagaagcagatccagaaactggaggccagggtacgggagctggaaggagaggttgagagtgagcaaaagcgtaatgctgaggctgtcaaaggtctgcgcaaacatgagaggcgagtgaaggaactcacttaccagacggaagaagatagaaagaatattctcaggcttcaagatttggtagataaacttcaggcaaaagtgaaatcttataagagacaagctgaggaggctgaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgcaaacaataaaaaaaaaaaag

SEQ ID NO: 361521 - DNA, 3189 bp, Homo sapiens
  misc_feature (27)..(27): n is a, c, g, or t
gggcctcccgcgaagagtataccgagngcaatccctgggggaacggccgccgccgctgccgcagccgccgtagccgccgcagccgcagccgccgctgccgccgaaccttaccctgtgtccggggccaagcgcaagtatcaggaggactcggaccccgagcgcagcgactatgaggagcagcagctgcagaaggaggaggaggcgcgcaaggtgaagagcggcatccgccagatgcgcctcttcagccaggacgagtgcgccaagatcgaggcccgcattgacgaggtggtgtcccgcgctgagaagggcctgtacaacgagcacacggtggaccgggccccactgcgcaacaagtacttcttcggcgaaggctacacttacggcgcccagctgcagaagcgcgggcccggccaggagcgcctctacccgccgggcgacgtggacgagatccccgagtgggtgcaccagctggtgatccaaaagctggtggagcaccgcgtcatccccgagggcttcgtcaacagcgccgtcatcaacgactaccagcccggcggctgcatcgtgtctcacgtggaccccatccacatcttcgagcgccccatcgtgtccgtgtccttctttagcgactctgcgctgtgcttcggctgcaagttccagttcaagcctattcgggtgtcggaaccagtgctttccctgccggtgcgcaggggaagcgtgactgtgctcagtggatatgctgctgatgaaatcactcactgcatacggcctcaggacatcaaggagcgccgagcagtcatcatcctcaggaagacaagattagatgcaccccggttggaaacaaagtccctgagcagctccgtgttaccacccagctatgcttcagatcgcctgtcaggaaacaacagggaccctgctctgaaacccaagcggtcccaccgcaaggcagaccctgatgctgcccacaggccacggatcctggagatggacaaggaagagaaccggcgctcggtgctgctgcccacacaccggcggaggggtagcttcagctctgagaactactggcgcaagtcatacgagtcctcagaggactgctctgaggcagcaggcagccctgcccgaaaggtgaagatgcggcggcactgagtctacccgccgccctcctgggaactctggctcatccttacgtagttgcccctccttttgttttgagggttttgtttttgttcattggggggtttttgttttttgttttttgttttttttgattctatatatttttccttggttttgttgcctgttaaggctgaagaatagaattggccaggacctaggttctcatattcttggtattcctcctggatggaaaggctgttggcatcaataggggacagaggctgatgctggagtggccagtagaggtggtggagcagagcagccatcttttaagtggggctgtatcaggctgggtttatttaaaagcaacaaaatgttttggttaagaaaattattttgctttcagtgtaaatcttcgcagtgttctaaacaaagttcagtcttctgctcgcccctttccctcactgatgtctgcacttggttgaggtctcctggagcctcacaggctctgctgttctccacttctcacctgccatccacgccctgcaagctcatgcaaacaccctttcttcctcctgcggcagagttgttcaggttgcctgggcaggggcttaaacagtgccagcccctgccatcccaaagctattgttaagccccccaggcgtcctccacccacgcccactagcctgccatgtccacagttccttgggctgctgaggggctagtgcagtggtcctgacctctcttatcaagagcacacttctttgctggttgctccttttgagcatatgcgtgtgattatttggaacagttagacttgccacgttgggtcagttttagaaattgtttctagctagagggactggtgtccttccaagtctagcatttggggtatggaaaattgttgtggtgtgtggtagggtttttgttttcttttttgagttttttttccccctttagtctcctggctttttcctttcccttcccttctccactggccagcttgggcctcatcctcatgtcatccttctaggaaggcgcctgccccatcttgtctgccggcagcatgcatccaaggccagagctcaggcctgcagactgggctggtgcctcctccgcttcagggtatgggagttggtgaaggggctttcaaaaaataataagaaaaaaaaggtaaagtctttggtagcttctatccactcagatcctggaaggcagcaaggttttgtggatctagattcattaggaatgtcttcttgtcagccaggccaggacccgggcttgccaagagcagaggccctcccagcaaccaggataccaccactttgggggctttgtgtacagaggtccgggtctgagacctcataggctgcttgagattattcagctaggaaggccatcactgatgccgccatgatggctgaggagctgaagaaggagcaggacaccagcgcccacctggagcggatgaagaagaacatggagcagaccgtgaaggatctgcagctccgtctggatgaggctgagcagctggccctgaagggtgggaagaagcagatccagaaactggaggccagggtacgggagctggaaggagaggttgagagtgagcaaaagcgtaatgctgaggctgtcaaaggtctgcgcaaacatgagaggcgagtgaaggaactcacttaccagacggaagaagatagaaagaatattctcaggcttcaagatttggtagataaacttcaggcaaaagtgaaatcttataagagacaagctgaggaggctgaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgcaaacaataaaaaaaaaaaag

SEQ ID NO: 361522 - DNA, 4167 bp, Homo sapiens
tttgcttaagagagaagtaaacatatctatttatttagttcaacagcctggagcagctgtgcatcaacttcaccaatgagaaactgcaacagtttttcaaccaccacatgttcgtgctggagcaggaggagtacaagaaggaaggcatcgagtggacgttcatcgacttcgggatggacctggctgcctgcatcgagctcatcgagaaggttggtctccttttcaacagctctgcagtgaaataaatatgcatttttaggtgccatggagcatgagcttgtcctccaccagctgaggtgtaacggtgtgctggaaggcatccgcatctgtaggaaaggatttccaagcagaatcctttatgcagacttcaaacagagatacaaggtattaaatgcaagtgcaatccctgaagggcaattcattgatagcaagaaggcctctgagaagctccttgcatccatcgacattgaccacacccagtataaatttgggcacaccaaggtctttttcaaagctggtcttctggggctcctagaggagatgcgagatgacaagctggcccagctgattacccgaacccaggccaggtgcagagggttcttggcaagagtggagtaccagaggatggtggagagaagggaggccatcttctgtatccagtacaatatcagatccttcatgaatgtcaagcactggccctggatgaaactcttcttcaagatcaagcctctgttgaagagtgcagaaactgagaaggagatggccaccatgaaggaagaatttcagaaaattaaagacgaacttgccaagtcagaggcaaaaaggaaggaactggaagaaaagatggtgacgctgttgaaagaaaaaaatgacttgcagctccaagttcaggctgaagccgaaggcttggctgatgcagaggaaaggtgtgaccagctaatcaaaaccaaaatccagctagaagccaaaatcaaagaggtgactgagagagctgaggatgaggaagagatcaatgctgagctgacagccaagaagaggaaactggaggatgaatgttcagaactcaagaaagacattgatgaccttgagctgacactggccaaggttgagaaggagaaacatgccacagaaaacaaggtgaaaaacctcacagaagagatggcaggtctggatgaaaccattgctaagctgaccaaggagaagaaggctctccaggaggcccaccagcagaccctggatgacctgcaggcagaggaggacaaagtcaacaccctgaccaaagctaaaatcaaacttgaacaacaagtggatgatcttgaagggtccttggagcaagaaaagaaacttcgcatggacctagaaagggctaagaggaaacttgagggtgacttgaagttggcccaagaatccataatggacattgaaaatgagaaacagcaacttgatgaaaagctcaaaaagaaagagtttgaaatcagcaatctgcaaagcaagattgaagatgaacaggcacttggcattcaattgcagaagaaaattaaagaattgcaagcccgcattgaggagctggaggaggaaatcgaggcggagcgggcctcccgggccaaagcagagaagcagcgctctgacctctcccgggagctggaggagatcagcgagaggctggaagaagccggtggggccacttcagcccagattgagatgaacaagaagcgggaggctgagttccagaaaatgcgcagggacctggaggaggccaccctacagcatgaagccacagcggccaccctgaggaagaagcatgcagatagtgtggccgagcttggggagcagattgacaacctgcagcgagtgaagcagaagctggagaaggagaagagtgagatgaagatggagattgatgaccttgctagtaatgtagaaacggtctccaaagccaagggaaacctagagaaaatgtgccggactctagaggaccaactgagtgaactgaaatcaaaggaagaggagcagcagcggctgatcaatgacctgactgcgcagagggggcgcctgcagactgaatctggtgagttttcacgccagcttgatgaaaaggaagctctggtgtctcagttatcaagaggcaaacaagcctttactcaacagattgaagaattaaagaggcaacttgaagaggagataaaagccaagaacgccctggcgcatgccctgcagtcttcccgccacgactgtgacctgctgcgggaacagtatgaggaggagcaggaatccaaggccgagctgcagagagcactgtccaaggccaacaccgaggttgcccaatggaggaccaaatacgagacggacgccatccagcgcacagaggagctggaggaggccaagaagaagctggcccagcggctgcaggcagctgaggaacatgtagaagctgtgaacgccaaatgtgcttccctcgaaaagacgaagcagcggctgcagaatgaggtcgaggacctcatgcttgatgtggagaggacaaatgccgcctgtgccgcccttgacaaaaagcaaaggaacttcgataagatcctggcagaatggaaacagaaatgtgaggaaacgcatgctgagcttgaggcctcccagaaggaagcccgttcccttggcactgagctgttcaagataaagaatgcctatgaggaatctttggatcagctagaaaccctgaagcgagagaacaaaaacttacagcaggagatttctgacctcacggaacagattgcagaaggagggaaacgtatccatgaactggagaaaataaagaaacaagtggaacaagaaaagtgtgaacttcaggctgctttagaagaagcagaggcatctcttgaacatgaagagggaaagatcctgcgcatccagcttgagttgaaccaagtcaagtctgaggttgataggaaaattgctgaaaaagatgaggaaattgaccagctgaagagaaaccacattagaatcgtggagtccatgcagagcacgctggatgctgagatcaggagtaggaatgatgccattaggctcaagaagaagatggagggagacctcaatgaaatggaaatccagctgaaccatgccaaccgcatggctgctgaggccctgaggaactacaggaacacccaaggcatcctcaaggatacccagatccacctggatgatgctctccggagccaggaggacctgaaggaacagctggccatggtggagcgcagagccaacctgctgcaggctgagatcgaggagctgcgggccactctggaacagacagagaggagcagaaaaatcgcagaacaggagctcctggatgccagtgagcgtgttcagctactgcacacccagaacaccagcctgatcaacaccaagaagaagctggagacagatatttcccaaatgcaaggagagatggaggacattctccaggaagcccgcaatgcagaagaaaaggccaagaaggccatcactgatgccgccatgatggctgaggagctgaagaaggagcaggacaccagcgcccacctggagcggatgaagaagaacatggagcagaccgtgaaggatctgcagctccgtctggatgaggctgagcagctggccctgaagggtgggaagaagcagatccagaaactggaggccagggtacgggagctggaaggagaggttgagagtgagcaaaagcgtaatgctgaggctgtcaaaggtctgcgcaaacatgagaggcgagtgaaggaactcacttaccagacggaagaagatagaaagaatattctcaggcttcaagatttggtagataaacttcaggcaaaagtgaaatcttataagagacaagctgaggaggctgaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgcaaacaataaaaaaaaaaaag

SEQ ID NO: 361523 - DNA, 2642 bp, Homo sapiens
ctagggtagcacagcctgtcattgggagtttccagacagaagtgttcccattccttactcctaaaggtggacttgaggagggtctttgaaagtcagctagaccaatctctagttgaacctcaaggagagtgaggtacagagcagagactgctggcttccaggtctagctggctcccacttggcctggccagagaattggtctgatggtgcccacaccttcaccggaggccctttggtgaccccatgcatgtttcctttgcaggacaagattagatgcaccccggttggaaacaaagtccctgagcagctccgtgttaccacccagctatgcttcagatcgcctgtcaggaaacaacagggaccctgctctgaaacccaagcggtcccaccgcaaggcagaccctgatgctgcccacaggccacggatcctggagatggacaaggaagagaaccggcgctcggtgctgctgcccacacaccggcggaggggtagcttcagctctgagaactactggcgcaagtcatacgagtcctcagaggactgctctgaggcagcaggcagccctgcccgaaaggtgaagatgcggcggcactgagtctacccgccgccctcctgggaactctggctcatccttacgtagttgcccctccttttgttttgagggttttgtttttgttcattggggggtttttgttttttgttttttgttttttttgattctatatatttttccttggttttgttgcctgttaaggctgaagaatagaattggccaggacctaggttctcatattcttggtattcctcctggatggaaaggctgttggcatcaataggggacagaggctgatgctggagtggccagtagaggtggtggagcagagcagccatcttttaagtggggctgtatcaggctgggtttatttaaaagcaacaaaatgttttggttaagaaaattattttgctttcagtgtaaatcttcgcagtgttctaaacaaagttcagtcttctgctcgcccctttccctcactgatgtctgcacttggttgaggtctcctggagcctcacaggctctgctgttctccacttctcacctgccatccacgccctgcaagctcatgcaaacaccctttcttcctcctgcggcagagttgttcaggttgcctgggcaggggcttaaacagtgccagcccctgccatcccaaagctattgttaagccccccaggcgtcctccacccacgcccactagcctgccatgtccacagttccttgggctgctgaggggctagtgcagtggtcctgacctctcttatcaagagcacacttctttgctggttgctccttttgagcatatgcgtgtgattatttggaacagttagacttgccacgttgggtcagttttagaaattgtttctagctagagggactggtgtccttccaagtctagcatttggggtatggaaaattgttgtggtgtgtggtagggtttttgttttcttttttgagttttttttccccctttagtctcctggctttttcctttcccttcccttctccactggccagcttgggcctcatcctcatgtcatccttctaggaaggcgcctgccccatcttgtctgccggcagcatgcatccaaggccagagctcaggcctgcagactgggctggtgcctcctccgcttcagggtatgggagttggtgaaggggctttcaaaaaataataagaaaaaaaaggtaaagtctttggtagcttctatccactcagatcctggaaggcagcaaggttttgtggatctagattcattaggaatgtcttcttgtcagccaggccaggacccgggcttgccaagagcagaggccctcccagcaaccaggataccaccactttgggggctttgtgtacagaggtccgggtctgagacctcataggctgcttgagattattcagctaggaaggccatcactgatgccgccatgatggctgaggagctgaagaaggagcaggacaccagcgcccacctggagcggatgaagaagaacatggagcagaccgtgaaggatctgcagctccgtctggatgaggctgagcagctggccctgaagggtgggaagaagcagatccagaaactggaggccagggtacgggagctggaaggagaggttgagagtgagcaaaagcgtaatgctgaggctgtcaaaggtctgcgcaaacatgagaggcgagtgaaggaactcacttaccagacggaagaagatagaaagaatattctcaggcttcaagatttggtagataaacttcaggcaaaagtgaaatcttataagagacaagctgaggaggctgaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgcaaacaataaaaaaaaaaaag

SEQ ID NO: 361524 - DNA, 3239 bp, Homo sapiens
catggcggccgccagcggctacacggacctgcgtgagaagctcaagtccatgacgtcccgggacaactataaggcgggcagccgggaggccgccgccgctgccgcagccgccgtagccgccgcagccgcagccgccgctgccgccgaaccttaccctgtgtccggggccaagcgcaagtatcaggaggactcggaccccgagcgcagcgactatgaggagcagcagctgcagaaggaggaggaggcgcgcaaggtgaagagcggcatccgccagatgcgcctcttcagccaggacgagtgcgccaagatcgaggcccgcattgacgaggtggtgtcccgcgctgagaagggcctgtacaacgagcacacggtggaccgggccccactgcgcaacaagtacttcttcggcgaaggctacacttacggcgcccagctgcagaagcgcgggcccggccaggagcgcctctacccgccgggcgacgtggacgagatccccgagtgggtgcaccagctggtgatccaaaagctggtggagcaccgcgtcatccccgagggcttcgtcaacagcgccgtcatcaacgactaccagcccggcggctgcatcgtgtctcacgtggaccccatccacatcttcgagcgccccatcgtgtccgtgtccttctttagcgactctgcgctgtgcttcggctgcaagttccagttcaagcctattcgggtgtcggaaccagtgctttccctgccggtgcgcaggggaagcgtgactgtgctcagtggatatgctgctgatgaaatcactcactgcatacggcctcaggacatcaaggagcgccgagcagtcatcatcctcaggaagacaagattagatgcaccccggttggaaacaaagtccctgagcagctccgtgttaccacccagctatgcttcagatcgcctgtcaggaaacaacagggaccctgctctgaaacccaagcggtcccaccgcaaggcagaccctgatgctgcccacaggccacggatcctggagatggacaaggaagagaaccggcgctcggtgctgctgcccacacaccggcggaggggtagcttcagctctgagaactactggcgcaagtcatacgagtcctcagaggactgctctgaggcagcaggcagccctgcccgaaaggtgaagatgcggcggcactgagtctacccgccgccctcctgggaactctggctcatccttacgtagttgcccctccttttgttttgagggttttgtttttgttcattggggggtttttgttttttgttttttgttttttttgattctatatatttttccttggttttgttgcctgttaaggctgaagaatagaattggccaggacctaggttctcatattcttggtattcctcctggatggaaaggctgttggcatcaataggggacagaggctgatgctggagtggccagtagaggtggtggagcagagcagccatcttttaagtggggctgtatcaggctgggtttatttaaaagcaacaaaatgttttggttaagaaaattattttgctttcagtgtaaatcttcgcagtgttctaaacaaagttcagtcttctgctcgcccctttccctcactgatgtctgcacttggttgaggtctcctggagcctcacaggctctgctgttctccacttctcacctgccatccacgccctgcaagctcatgcaaacaccctttcttcctcctgcggcagagttgttcaggttgcctgggcaggggcttaaacagtgccagcccctgccatcccaaagctattgttaagccccccaggcgtcctccacccacgcccactagcctgccatgtccacagttccttgggctgctgaggggctagtgcagtggtcctgacctctcttatcaagagcacacttctttgctggttgctccttttgagcatatgcgtgtgattatttggaacagttagacttgccacgttgggtcagttttagaaattgtttctagctagagggactggtgtccttccaagtctagcatttggggtatggaaaattgttgtggtgtgtggtagggtttttgttttcttttttgagttttttttccccctttagtctcctggctttttcctttcccttcccttctccactggccagcttgggcctcatcctcatgtcatccttctaggaaggcgcctgccccatcttgtctgccggcagcatgcatccaaggccagagctcaggcctgcagactgggctggtgcctcctccgcttcagggtatgggagttggtgaaggggctttcaaaaaataataagaaaaaaaaggtaaagtctttggtagcttctatccactcagatcctggaaggcagcaaggttttgtggatctagattcattaggaatgtcttcttgtcagccaggccaggacccgggcttgccaagagcagaggccctcccagcaaccaggataccaccactttgggggctttgtgtacagaggtccgggtctgagacctcataggctgcttgagattattcagctaggaaggccatcactgatgccgccatgatggctgaggagctgaagaaggagcaggacaccagcgcccacctggagcggatgaagaagaacatggagcagaccgtgaaggatctgcagctccgtctggatgaggctgagcagctggccctgaagggtgggaagaagcagatccagaaactggaggccagggtacgggagctggaaggagaggttgagagtgagcaaaagcgtaatgctgaggctgtcaaaggtctgcgcaaacatgagaggcgagtgaaggaactcacttaccagacggaagaagatagaaagaatattctcaggcttcaagatttggtagataaacttcaggcaaaagtgaaatcttataagagacaagctgaggaggctgaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgattgttcctcagcctcctcagcttgtctctataagatttcacttttgcctgaagtttatctaccaaatcttgaagcctgagaatattctttctatcttcttccgtctggtaagtgagttccttactcgcctctaatgtatgcgcagaccttgacagcta

SEQ ID NO: 361525 - DNA, 992 bp, Homo sapiens
cttccaccagcaaaagtactgggccagccccgcgttgatatgtggaagggagctgtggaaggctcccttccaccaacctgctgcaggctgagatcgaggagctgcgggccactctggaacagacagagaggagcagaaaaatcgcagaacaggagctcctggatgccagtgagcgtgttcagctactgcacacccagaacaccagcctgatcaacaccaagaagaagctggagacagatatttcccaaatgcaaggagagatggaggacattctccaggaagcccgcaatgcagaagaaaaggccaagaaggccatcactgatgccgccatgatggctgaggagctgaagaaggagcaggacaccagcgcccacctggagcggatgaagaagaacatggagcagaccgtgaaggatctgcagctccgtctggatgaggctgagcagctggccctgaagggtgggaagaagcagatccagaaactggaggccagggtacgggagctggaaggagaggttgagagtgagcaaaagcgtaatgctgaggctgtcaaaggtctgcgcaaacatgagaggcgagtgaaggaactcacttaccagacggaagaagatagaaagaatattctcaggcttcaagatttggtagataaacttcaggcaaaagtgaaatcttataagagacaagctgaggaggctgaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgcaaacaataaaaaaaaaaaag

SEQ ID NO: 361526 - DNA, 897 bp, Homo sapiens
  misc_feature (47)..(47): n is a, c, g, or t
ttgttactcctcgtaccaaaaaggaccagaacaaaaagtttacttcnattgttcccataggaaactcagcttggttagtgtgtcaggcactttctgagataccagcccacccctcgggccctcccagcaaccaggataccaccactttgggggctttgtgtacagaggtccgggtctgagacctcataggctgcttgagattattcagctaggaaggccatcactgatgccgccatgatggctgaggagctgaagaaggagcaggacaccagcgcccacctggagcggatgaagaagaacatggagcagaccgtgaaggatctgcagctccgtctggatgaggctgagcagctggccctgaagggtgggaagaagcagatccagaaactggaggccagggtacgggagctggaaggagaggttgagagtgagcaaaagcgtaatgctgaggctgtcaaaggtctgcgcaaacatgagaggcgagtgaaggaactcacttaccagacggaagaagatagaaagaatattctcaggcttcaagatttggtagataaacttcaggcaaaagtgaaatcttataagagacaagctgaggaggctgaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgcaaacaataaaaaaaaaaaag

SEQ ID NO: 361527 - DNA, 710 bp, Homo sapiens
tccaacgatggtcctcagctatcatgaaggccatcactgatgccgccatgatggctgaggagctgaagaaggagcaggacaccagcgcccacctggagcggatgaagaagaacatggagcagaccgtgaaggatctgcagctccgtctggatgaggctgagcagctggccctgaagggtgggaagaagcagatccagaaactggaggccagggtacgggagctggaaggagaggttgagagtgagcaaaagcgtaatgctgaggctgtcaaaggtctgcgcaaacatgagaggcgagtgaaggaactcacttaccagacggaagaagatagaaagaatattctcaggcttcaagatttggtagataaacttcaggcaaaagtgaaatcttataagagacaagctgaggaggctgaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgcaaacaataaaaaaaaaaaag

SEQ ID NO: 361528 - DNA, 2719 bp, Homo sapiens
catggcggccgccagcggctacacggacctgcgtgagaagctcaagtccatgacgtcccgggacaactataaggcgggcagccgggaggccgccgccgctgccgcagccgccgtagccgccgcagccgcagccgccgctgccgccgaaccttaccctgtgtccggggccaagcgcaagtatcaggaggactcggaccccgagcgcagcgactatgaggagcagcagctgcagaaggaggaggaggcgcgcaaggtgaagagcggcatccgccagatgcgcctcttcagccaggacgagtgcgccaagatcgaggcccgcattgacgaggtggtgtcccgcgctgagaagggcctgtacaacgagcacacggtggaccgggccccactgcgcaacaagtacttcttcggcgaaggctacacttacggcgcccagctgcagaagcgcgggcccggccaggagcgcctctacccgccgggcgacgtggacgagatccccgagtgggtgcaccagctggtgatccaaaagctggtggagcaccgcgtcatccccgagggcttcgtcaacagcgccgtcatcaacgactaccagcccggcggctgcatcgtgtctcacgtggaccccatccacatcttcgagcgccccatcgtgtccgtgtccttctttagcgactctgcgctgtgcttcggctgcaagttccagttcaagcctattcgggtgtcggaaccagtgctttccctgccggtgcgcaggggaagcgtgactgtgctcagtggatatgctgctgatgaaatcactcactgcatacggcctcaggacatcaaggagcgccgagcagtcatcatcctcaggaagacaagattagatgcaccccggttggaaacaaagtccctgagcagctccgtgttaccacccagctatgcttcagatcgcctgtcaggaaacaacagggaccctgctctgaaacccaagcggtcccaccgcaaggcagaccctgatgctgcccacaggccacggatcctggagatggacaaggaagagaaccggcgctcggtgctgctgcccacacaccggcggaggggtagcttcagctctgagaactactggcgcaagtcatacgagtcctcagaggactgctctgaggcagcaggcagccctgcccgaaaggtgaagatgcggcggcactgagtctacccgccgccctcctgggaactctggctcatccttacgtagttgcccctccttttgttttgagggttttgtttttgttcattggggggtttttgttttttgttttttgttttttttgattctatatatttttccttggttttgttgcctgttaaggctgaagaatagaattggccaggacctaggttctcatattcttggtattcctcctggatggaaaggctgttggcatcaataggggacagaggctgatgctggagtggccagtagaggtggtggagcagagcagccatcttttaagtggggctgtatcaggctgggtttatttaaaagcaacaaaatgttttggttaagaaaattattttgctttcagtgtaaatcttcgcagtgttctaaacaaagttcagtcttctgctcgcccctttccctcactgatgtctgcacttggttgaggtctcctggagcctcacaggctctgctgttctccacttctcacctgccatccacgccctgcaagctcatgcaaacaccctttcttcctcctgcggcagagttgttcaggttgcctgggcaggggcttaaacagtgccagcccctgccatcccaaagctattgttaagccccccaggcgtcctccacccacgcccactagcctgccatgtccacagttccttgggctgctgaggggctagtgcagtggtcctgacctctcttatcaagagcacacttctttgctggttgctccttttgagcatatgcgtgtgattatttggaacagttagacttgccacgttgggtcagttttagaaattgtttctagcaaccaggataccaccactttgggggctttgtgtacagaggtccgggtctgagacctcataggctgcagaaatctggggcagccaccatcaagaagcccctctcaggggccagaactcctttgccagcgtggatttctcaagtcgggactgcataattaaagcagttgcagttttattttttttacagcttttttcccaaaaatgatttgtagttgtgtgtgcagcacttcgccctgatatgtgtgctctacaataaaaaccaaatctaatatattttggaaacagttgtctgatgttgttgtaagagagggcttgcctttggtgcttccttaatccctttactttcttaaacttgaaacaggggttggggaggcagagctagctcattggccgccagcgtcccagaggagttggttggtcttggacactgggcctcctgtgtgcctagccttggatttatggctgaaggtggacttgccctcaccccactgtcctttctcccactccaaggagggtgaacttcataaaccacaatgtccaggtgcccagggaccacaccttctggagttctggaagtccctcttttagatatgatcactgagaggctggtgctggtgaagggggagatggcaggcacaaaagcaagggagaacctggcttttgtggaaaatatgcgagtgattttgctcattaaacaaatacttggcca

SEQ ID NO: 361529 - DNA, 4848 bp, Homo sapiens
gaggacgggcctttcaagagggacactggtcacaccgcccagtgtcagcagcagctgctagttctgaactgtctcactcccaggctacatcttctcacttgctaacaaggacctctgagttcagcagccatgagttcagactcagaattggctgtttttggggaggctgctcctttcctccgaaagtctgaaagggagcgcattgaggcccagaataggccctttgatgccaaaacatctgtctttgtggcggagcccaaagaatcctttgtcaaagggaccatccagagcagagaaggaggaaaagtgacggtgaagactgagggaggagcgactctgacagtgaaggatgatcaggtcttccccatgaaccctcccaaatatgacaagatcgaggatatggccatgatgactcatctgcatgagcctgctgtgctgtacaacctcaaagaacgttatgcagcctggatgatctacacctattcaggtctcttctgtgtcactgtcaacccctacaagtggctgcctgtgtataagcccgaggtggtgacagcctaccgaggcaaaaagcgccaggaggccccgccccacatcttctccatctctgacaacgcctatcagttcatgctgactgaccgagagaatcagtcaatcctgatcactggagaatctggtgcagggaagactgtgaacaccaagcgtgtcatccagtactttgcaacaattgcagttactggtgagaagaagaaggaagaaattacttctggcaaaatacaggggactctggaagatcaaatcatcagtgccaaccccctactggaggcctttggcaacgccaagaccgtgaggaatgacaactcctctcgctttggtaaattcatcagaatccactttggcactactggaaaactggcatctgctgatattgaaacatatctgctagagaagtctagagttgttttccagcttaaggctgagagaagttatcatattttttaccagattacatcgaataagaaaccagaacttattgaaatgcttctgattaccacgaacccatatgattacccatttgtcagtcaaggggagatcagtgtggccagcatcgatgatcaggaagaactgatggccacagatagtgctattgatattttgggctttactaatgaagaaaaggtctccatttacaagctcacgggggctgtgatgcattatgggaacctaaaatttaagcaaaagcagcgtgaggagcaagcagagccagatggcacagaagttgctgacaaggcggcctacctccagagtctgaactctgcagatctgctcaaagctctctgctaccccagggtcaaggtcggcaatgagtatgtcaccaaaggccagactgtagaacaggtgtccaacgcagtaggtgctctggccaaagccgtctacgagaagatgttcctgtggatggttgcccgcatcaaccagcagctggacaccaagcagcccaggcagtacttcatcggggtcttggacattgctggttttgagatttttgatttcaacagcctggagcagctgtgcatcaacttcaccaatgagaaactgcaacagtttttcaaccaccacatgttcgtgctggagcaggaggagtacaagaaggaaggcatcgagtggacgttcatcgacttcgggatggacctggctgcctgcatcgagctcatcgagaaggttggtcctatgggcatcttctccatcctggaagaggagtgcatgttccctaaggcaacagacacctccttcaagaacaagctgtatgaccagcacctgggcaagtctgccaacttccagaagcccaaggtggtcaaaggcaaggccgaggcccacttcgctctgattcactatgctggtgttgtggactacaacattactggctggctggagaagaacaaggaccccctgaatgagaccgtggttggactgtaccagaagtctgcaatgaaaactctagctcagctcttctctggggctcaaactgctgaaggagagggagctggtggaggggccaagaaaggtggtaagaagaagggctcttctttccagacagtgtctgcccttttcagagagaatttgaacaagctgatgaccaacctcaggagtacccatcctcactttgtgaggtgtatcatccccaatgagacaaaaactcctggtgccatggagcatgagcttgtcctccaccagctgaggtgtaacggtgtgctggaaggcatccgcatctgtaggaaaggatttccaagcagaatcctttatgcagacttcaaacagagatacaaggtattaaatgcaagtgcaatccctgaagggcaattcattgatagcaagaaggcctctgagaagctccttgcatccatcgacattgaccacacccagtataaatttgggcacaccaaggtctttttcaaagctggtcttctggggctcctagaggagatgcgagatgacaagctggcccagctgattacccgaacccaggccaggtgcagagggttcttggcaagagtggagtaccagaggatggtggagagaagggaggccatcttctgtatccagtacaatatcagatccttcatgaatgtcaagcactggccctggatgaaactcttcttcaagatcaagcctctgttgaagagtgcagaaactgagaaggagatggccaccatgaaggaagaatttcagaaaattaaagacgaacttgccaagtcagaggcaaaaaggaaggaactggaagaaaagatggtgacgctgttgaaagaaaaaaatgacttgcagctccaagttcaggctgaagccgaaggcttggctgatgcagaggaaaggtgtgaccagctaatcaaaaccaaaatccagctagaagccaaaatcaaagaggtgactgagagagctgaggatgaggaagagatcaatgctgagctgacagccaagaagaggaaactggaggatgaatgttcagaactcaagaaagacattgatgaccttgagctgacactggccaaggttgagaaggagaaacatgccacagaaaacaaggtgaaaaacctcacagaagagatggcaggtctggatgaaaccattgctaagctgaccaaggagaagaaggctctccaggaggcccaccagcagaccctggatgacctgcaggcagaggaggacaaagtcaacaccctgaccaaagctaaaatcaaacttgaacaacaagtggatgatcttgaagggtccttggagcaagaaaagaaacttcgcatggacctagaaagggctaagaggaaacttgagggtgacttgaagttggcccaagaatccataatggacattgaaaatgagaaacagcaacttgatgaaaagctcaaaaagaaagagtttgaaatcagcaatctgcaaagcaagattgaagatgaacaggcacttggcattcaattgcagaagaaaattaaagaattgcaagcccgcattgaggagctggaggaggaaatcgaggcggagcgggcctcccgggccaaagcagagaagcagcgctctgacctctcccgggagctggaggagatcagcgagaggctggaagaagccggtggggccacttcagcccagattgagatgaacaagaagcgggaggctgagttccagaaaatgcgcagggacctggaggaggccaccctacagcatgaagccacagcggccaccctgaggaagaagcatgcagatagtgtggccgagcttggggagcagattgacaacctgcagcgagtgaagcagaagctggagaaggagaagagtgagatgaagatggagattgatgaccttgctagtaatgtagaaacggtctccaaagccaagggaaacctagagaaaatgtgccggactctagaggaccaactgagtgaactgaaatcaaaggaagaggagcagcagcggctgatcaatgacctgactgcgcagagggggcgcctgcagactgaatctggtgagttttcacgccagcttgatgaaaaggaagctctggtgtctcagttatcaagaggcaaacaagcctttactcaacagattgaagaattaaagaggcaacttgaagaggagataaaagccaagaacgccctggcgcatgccctgcagtcttcccgccacgactgtgacctgctgcgggaacagtatgaggaggagcaggaatccaaggccgagctgcagagagcactgtccaaggccaacaccgaggttgcccaatggaggaccaaatacgagacggacgccatccagcgcacagaggagctggaggaggccaagaagaagctggcccagcggctgcaggcagctgaggaacatgtagaagctgtgaacgccaaatgtgcttccctcgaaaagacgaagcagcggctgcagaatgaggtcgaggacctcatgcttgatgtggagaggacaaatgccgcctgtgccgcccttgacaaaaagcaaaggaacttcgataagatcctggcagaatggaaacagaaatgtgaggaaacgcatgctgagcttgaggcctcccagaaggaagcccgttcccttggcactgagctgttcaagataaagaatgcctatgaggaatctttggatcagctagaaaccctgaagcgagagaacaaaaacttacagcaggagatttctgacctcacggaacagattgcagaaggagggaaacgtatccatgaactggagaaaataaagaaacaagtggaacaagaaaagtgtgaacttcaggctgctttagaagaagcagaggtcactataatcacttcacaagtatggtacatatttggaagtgatgtcacg

SEQ ID NO: 361530 - DNA, 207 bp, Homo sapiens
gaggacgggcctttcaagagggacactggtcacaccgcccagtgtcagcagcagctgctagttctggtactgctccttctggaactgcacgttttacctctatgaattttgttacttctgtttacaatagcaagccatgccataaatgggattttttccccctctttttggtcaactaatcaagtgcttttcccttttcttttatag

SEQ ID NO: 361531 - DNA, 6063 bp, Homo sapiens
ggtcctgctttaaaaagctccaagaactgtctcactcccaggctacatcttctcacttgctaacaaggacctctgagttcagcagccatgagttcagactcagaattggctgtttttggggaggctgctcctttcctccgaaagtctgaaagggagcgcattgaggcccagaataggccctttgatgccaaaacatctgtctttgtggcggagcccaaagaatcctttgtcaaagggaccatccagagcagagaaggaggaaaagtgacggtgaagactgagggaggagcgactctgacagtgaaggatgatcaggtcttccccatgaaccctcccaaatatgacaagatcgaggatatggccatgatgactcatctgcatgagcctgctgtgctgtacaacctcaaagaacgttatgcagcctggatgatctacacctattcaggtctcttctgtgtcactgtcaacccctacaagtggctgcctgtgtataagcccgaggtggtgacagcctaccgaggcaaaaagcgccaggaggccccgccccacatcttctccatctctgacaacgcctatcagttcatgctgactgaccgagagaatcagtcaatcctgatcactggagaatctggtgcagggaagactgtgaacaccaagcgtgtcatccagtactttgcaacaattgcagttactggtgagaagaagaaggaagaaattacttctggcaaaatacaggggactctggaagatcaaatcatcagtgccaaccccctactggaggcctttggcaacgccaagaccgtgaggaatgacaactcctctcgctttggtaaattcatcagaatccactttggcactactggaaaactggcatctgctgatattgaaacatatctgctagagaagtctagagttgttttccagcttaaggctgagagaagttatcatattttttaccagattacatcgaataagaaaccagaacttattgaaatgcttctgattaccacgaacccatatgattacccatttgtcagtcaaggggagatcagtgtggccagcatcgatgatcaggaagaactgatggccacagatagtgctattgatattttgggctttactaatgaagaaaaggtctccatttacaagctcacgggggctgtgatgcattatgggaacctaaaatttaagcaaaagcagcgtgaggagcaagcagagccagatggcacagaagttgctgacaaggcggcctacctccagagtctgaactctgcagatctgctcaaagctctctgctaccccagggtcaaggtcggcaatgagtatgtcaccaaaggccagactgtagaacaggtgtccaacgcagtaggtgctctggccaaagccgtctacgagaagatgttcctgtggatggttgcccgcatcaaccagcagctggacaccaagcagcccaggcagtacttcatcggggtcttggacattgctggttttgagatttttgatttcaacagcctggagcagctgtgcatcaacttcaccaatgagaaactgcaacagtttttcaaccaccacatgttcgtgctggagcaggaggagtacaagaaggaaggcatcgagtggacgttcatcgacttcgggatggacctggctgcctgcatcgagctcatcgagaaggttggtcctatgggcatcttctccatcctggaagaggagtgcatgttccctaaggcaacagacacctccttcaagaacaagctgtatgaccagcacctgggcaagtctgccaacttccagaagcccaaggtggtcaaaggcaaggccgaggcccacttcgctctgattcactatgctggtgttgtggactacaacattactggctggctggagaagaacaaggaccccctgaatgagaccgtggttggactgtaccagaagtctgcaatgaaaactctagctcagctcttctctggggctcaaactgctgaaggagagggagctggtggaggggccaagaaaggtggtaagaagaagggctcttctttccagacagtgtctgcccttttcagagagaatttgaacaagctgatgaccaacctcaggagtacccatcctcactttgtgaggtgtatcatccccaatgagacaaaaactcctggtgccatggagcatgagcttgtcctccaccagctgaggtgtaacggtgtgctggaaggcatccgcatctgtaggaaaggatttccaagcagaatcctttatgcagacttcaaacagagatacaaggtattaaatgcaagtgcaatccctgaagggcaattcattgatagcaagaaggcctctgagaagctccttgcatccatcgacattgaccacacccagtataaatttgggcacaccaaggtctttttcaaagctggtcttctggggctcctagaggagatgcgagatgacaagctggcccagctgattacccgaacccaggccaggtgcagagggttcttggcaagagtggagtaccagaggatggtggagagaagggaggccatcttctgtatccagtacaatatcagatccttcatgaatgtcaagcactggccctggatgaaactcttcttcaagatcaagcctctgttgaagagtgcagaaactgagaaggagatggccaccatgaaggaagaatttcagaaaattaaagacgaacttgccaagtcagaggcaaaaaggaaggaactggaagaaaagatggtgacgctgttgaaagaaaaaaatgacttgcagctccaagttcaggctgaagccgaaggcttggctgatgcagaggaaaggtgtgaccagctaatcaaaaccaaaatccagctagaagccaaaatcaaagaggtgactgagagagctgaggatgaggaagagatcaatgctgagctgacagccaagaagaggaaactggaggatgaatgttcagaactcaagaaagacattgatgaccttgagctgacactggccaaggttgagaaggagaaacatgccacagaaaacaaggtgaaaaacctcacagaagagatggcaggtctggatgaaaccattgctaagctgaccaaggagaagaaggctctccaggaggcccaccagcagaccctggatgacctgcaggcagaggaggacaaagtcaacaccctgaccaaagctaaaatcaaacttgaacaacaagtggatgatcttgaagggtccttggagcaagaaaagaaacttcgcatggacctagaaagggctaagaggaaacttgagggtgacttgaagttggcccaagaatccataatggacattgaaaatgagaaacagcaacttgatgaaaagctcaaaaagaaagagtttgaaatcagcaatctgcaaagcaagattgaagatgaacaggcacttggcattcaattgcagaagaaaattaaagaattgcaagcccgcattgaggagctggaggaggaaatcgaggcggagcgggcctcccgggccaaagcagagaagcagcgctctgacctctcccgggagctggaggagatcagcgagaggctggaagaagccggtggggccacttcagcccagattgagatgaacaagaagcgggaggctgagttccagaaaatgcgcagggacctggaggaggccaccctacagcatgaagccacagcggccaccctgaggaagaagcatgcagatagtgtggccgagcttggggagcagattgacaacctgcagcgagtgaagcagaagctggagaaggagaagagtgagatgaagatggagattgatgaccttgctagtaatgtagaaacggtctccaaagccaagggaaacctagagaaaatgtgccggactctagaggaccaactgagtgaactgaaatcaaaggaagaggagcagcagcggctgatcaatgacctgactgcgcagagggggcgcctgcagactgaatctggtgagttttcacgccagcttgatgaaaaggaagctctggtgtctcagttatcaagaggcaaacaagcctttactcaacagattgaagaattaaagaggcaacttgaagaggagataaaagccaagaacgccctggcgcatgccctgcagtcttcccgccacgactgtgacctgctgcgggaacagtatgaggaggagcaggaatccaaggccgagctgcagagagcactgtccaaggccaacaccgaggttgcccaatggaggaccaaatacgagacggacgccatccagcgcacagaggagctggaggaggccaagaagaagctggcccagcggctgcaggcagctgaggaacatgtagaagctgtgaacgccaaatgtgcttccctcgaaaagacgaagcagcggctgcagaatgaggtcgaggacctcatgcttgatgtggagaggacaaatgccgcctgtgccgcccttgacaaaaagcaaaggaacttcgataagatcctggcagaatggaaacagaaatgtgaggaaacgcatgctgagcttgaggcctcccagaaggaagcccgttcccttggcactgagctgttcaagataaagaatgcctatgaggaatctttggatcagctagaaaccctgaagcgagagaacaaaaacttacagcaggagatttctgacctcacggaacagattgcagaaggagggaaacgtatccatgaactggagaaaataaagaaacaagtggaacaagaaaagtgtgaacttcaggctgctttagaagaagcagaggcatctcttgaacatgaagagggaaagatcctgcgcatccagcttgagttgaaccaagtcaagtctgaggttgataggaaaattgctgaaaaagatgaggaaattgaccagctgaagagaaaccacattagaatcgtggagtccatgcagagcacgctggatgctgagatcaggagtaggaatgatgccattaggctcaagaagaagatggagggagacctcaatgaaatggaaatccagctgaaccatgccaaccgcatggctgctgaggccctgaggaactacaggaacacccaaggcatcctcaaggatacccagatccacctggatgatgctctccggagccaggaggacctgaaggaacagctggccatggtggagcgcagagccaacctgctgcaggctgagatcgaggagctgcgggccactctggaacagacagagaggagcagaaaaatcgcagaacaggagctcctggatgccagtgagcgtgttcagctactgcacacccagaacaccagcctgatcaacaccaagaagaagctggagacagatatttcccaaatgcaaggagagatggaggacattctccaggaagcccgcaatgcagaagaaaaggccaagaaggccatcactgatgccgccatgatggctgaggagctgaagaaggagcaggacaccagcgcccacctggagcggatgaagaagaacatggagcagaccgtgaaggatctgcagctccgtctggatgaggctgagcagctggccctgaagggtgggaagaagcagatccagaaactggaggccagggtacgggagctggaaggagaggttgagagtgagcaaaagcgtaatgctgaggctgtcaaaggtctgcgcaaacatgagaggcgagtgaaggaactcacttaccagacggaagaagatagaaagaatattctcaggcttcaagatttggtagataaacttcaggcaaaagtgaaatcttataagagacaagctgaggaggctgaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgcaaacaataaaaaaaaaaaag

SEQ ID NO: 361532 - DNA, 2739 bp, Homo sapiens
catggcggccgccagcggctacacggacctgcgtgagaagctcaagtccatgacgtcccgggacaactataaggcgggcagccgggaggccgccgccgctgccgcagccgccgtagccgccgcagccgcagccgccgctgccgccgaaccttaccctgtgtccggggccaagcgcaagtatcaggaggactcggaccccgagcgcagcgactatgaggagcagcagctgcagaaggaggaggaggcgcgcaaggtgaagagcggcatccgccagatgcgcctcttcagccaggacgagtgcgccaagatcgaggcccgcattgacgaggtggtgtcccgcgctgagaagggcctgtacaacgagcacacggtggaccgggccccactgcgcaacaagtacttcttcggcgaaggctacacttacggcgcccagctgcagaagcgcgggcccggccaggagcgcctctacccgccgggcgacgtggacgagatccccgagtgggtgcaccagctggtgatccaaaagctggtggagcaccgcgtcatccccgagggcttcgtcaacagcgccgtcatcaacgactaccagcccggcggctgcatcgtgtctcacgtggaccccatccacatcttcgagcgccccatcgtgtccgtgtccttctttagcgactctgcgctgtgcttcggctgcaagttccagttcaagcctattcgggtgtcggaaccagtgctttccctgccggtgcgcaggggaagcgtgactgtgctcagtggatatgctgctgatgaaatcactcactgcatacggcctcaggacatcaaggagcgccgagcagtcatcatcctcaggaagacaagattagatgcaccccggttggaaacaaagtccctgagcagctccgtgttaccacccagctatgcttcagatcgcctgtcaggaaacaacagggaccctgctctgaaacccaagcggtcccaccgcaaggcagaccctgatgctgcccacaggccacggatcctggagatggacaaggaagagaaccggcgctcggtgctgctgcccacacaccggcggaggggtagcttcagctctgagaactactggcgcaagtcatacgagtcctcagaggactgctctgaggcagcaggcagccctgcccgaaaggtgaagatgcggcggcactgagtctacccgccgccctcctgggaactctggctcatccttacgtagttgcccctccttttgttttgagggttttgtttttgttcattggggggtttttgttttttgttttttgttttttttgattctatatatttttccttggttttgttgcctgttaaggctgaagaatagaattggccaggacctaggttctcatattcttggtattcctcctggatggaaaggctgttggcatcaataggggacagaggctgatgctggagtggccagtagaggtggtggagcagagcagccatcttttaagtggggctgtatcaggctgggtttatttaaaagcaacaaaatgttttggttaagaaaattattttgctttcagtgtaaatcttcgcagtgttctaaacaaagttcagtcttctgctcgcccctttccctcactgatgtctgcacttggttgaggtctcctggagcctcacaggctctgctgttctccacttctcacctgccatccacgccctgcaagctcatgcaaacaccctttcttcctcctgcggcagagttgttcaggttgcctgggcaggggcttaaacagtgccagcccctgccatcccaaagctattgttaagccccccaggcgtcctccacccacgcccactagcctgccatgtccacagttccttgggctgctgaggggctagtgcagtggtcctgacctctcttatcaagagcacacttctttgctggttgctccttttgagcatatgcgtgtgattatttggaacagttagacttgccacgttgggtcagttttagaaattgtttctagctagagggactggtgtccttccaagtctagcatttggggtatggaaaattgttgtggtgtgtggtagggtttttgttttcttttttgagttttttttccccctttagtctcctggctttttcctttcccttcccttctccactggccagcttgggcctcatcctcatgtcatccttctaggaaggcgcctgccccatcttgtctgccggcagcatgcatccaaggccagagctcaggcctgcagactgggctggtgcctcctccgcttcagggtatgggagttggtgaaggggctttcaaaaaataataagaaaaaaaaggtaaagtctttggtagcttctatccactcagatcctggaaggcagcaaggttttgtggatctagattcattaggaatgtcttcttgtcagccaggccaggacccgggcttgccaagagcagaggccctcccagcaaccaggataccaccactttgggggctttgtgtacagaggtccgggtctgagacctcataggctgcagaaatctggggcagccaccatcaagaagcccctctcaggggccagaactcctttgccagcgtggatttctcaagtcgggactgcataattaaagcagttgcagttttattttttttacagcttttttcccaaaaatgatttgtagttgtgtgtgcagcacttcgccctgatatgtgtgctctacaataaaaaccaaatctaatatattt

SEQ ID NO: 361533 - DNA, 4963 bp, Homo sapiens
catgttggccaggctggtcttgaactcctgacctcagatgaaccacccaccttggcctcccaaagtgctgggactacaagcatgagccaccgtgcctggcaaaaatatcaaatttttaatttattttaattaaattgctgacaaggcggcctacctccagagtctgaactctgcagatctgctcaaagctctctgctaccccagggtcaaggtcggcaatgagtatgtcaccaaaggccagactgtagaacaggtgtccaacgcagtaggtgctctggccaaagccgtctacgagaagatgttcctgtggatggttgcccgcatcaaccagcagctggacaccaagcagcccaggcagtacttcatcggggtcttggacattgctggttttgagatttttgatttcaacagcctggagcagctgtgcatcaacttcaccaatgagaaactgcaacagtttttcaaccaccacatgttcgtgctggagcaggaggagtacaagaaggaaggcatcgagtggacgttcatcgacttcgggatggacctggctgcctgcatcgagctcatcgagaaggttggtcctatgggcatcttctccatcctggaagaggagtgcatgttccctaaggcaacagacacctccttcaagaacaagctgtatgaccagcacctgggcaagtctgccaacttccagaagcccaaggtggtcaaaggcaaggccgaggcccacttcgctctgattcactatgctggtgttgtggactacaacattactggctggctggagaagaacaaggaccccctgaatgagaccgtggttggactgtaccagaagtctgcaatgaaaactctagctcagctcttctctggggctcaaactgctgaaggagagggagctggtggaggggccaagaaaggtggtaagaagaagggctcttctttccagacagtgtctgcccttttcagagagaatttgaacaagctgatgaccaacctcaggagtacccatcctcactttgtgaggtgtatcatccccaatgagacaaaaactcctggtgccatggagcatgagcttgtcctccaccagctgaggtgtaacggtgtgctggaaggcatccgcatctgtaggaaaggatttccaagcagaatcctttatgcagacttcaaacagagatacaaggtattaaatgcaagtgcaatccctgaagggcaattcattgatagcaagaaggcctctgagaagctccttgcatccatcgacattgaccacacccagtataaatttgggcacaccaaggtctttttcaaagctggtcttctggggctcctagaggagatgcgagatgacaagctggcccagctgattacccgaacccaggccaggtgcagagggttcttggcaagagtggagtaccagaggatggtggagagaagggaggccatcttctgtatccagtacaatatcagatccttcatgaatgtcaagcactggccctggatgaaactcttcttcaagatcaagcctctgttgaagagtgcagaaactgagaaggagatggccaccatgaaggaagaatttcagaaaattaaagacgaacttgccaagtcagaggcaaaaaggaaggaactggaagaaaagatggtgacgctgttgaaagaaaaaaatgacttgcagctccaagttcaggctgaagccgaaggcttggctgatgcagaggaaaggtgtgaccagctaatcaaaaccaaaatccagctagaagccaaaatcaaagaggtgactgagagagctgaggatgaggaagagatcaatgctgagctgacagccaagaagaggaaactggaggatgaatgttcagaactcaagaaagacattgatgaccttgagctgacactggccaaggttgagaaggagaaacatgccacagaaaacaaggtgaaaaacctcacagaagagatggcaggtctggatgaaaccattgctaagctgaccaaggagaagaaggctctccaggaggcccaccagcagaccctggatgacctgcaggcagaggaggacaaagtcaacaccctgaccaaagctaaaatcaaacttgaacaacaagtggatgatcttgaagggtccttggagcaagaaaagaaacttcgcatggacctagaaagggctaagaggaaacttgagggtgacttgaagttggcccaagaatccataatggacattgaaaatgagaaacagcaacttgatgaaaagctcaaaaagaaagagtttgaaatcagcaatctgcaaagcaagattgaagatgaacaggcacttggcattcaattgcagaagaaaattaaagaattgcaagcccgcattgaggagctggaggaggaaatcgaggcggagcgggcctcccgggccaaagcagagaagcagcgctctgacctctcccgggagctggaggagatcagcgagaggctggaagaagccggtggggccacttcagcccagattgagatgaacaagaagcgggaggctgagttccagaaaatgcgcagggacctggaggaggccaccctacagcatgaagccacagcggccaccctgaggaagaagcatgcagatagtgtggccgagcttggggagcagattgacaacctgcagcgagtgaagcagaagctggagaaggagaagagtgagatgaagatggagattgatgaccttgctagtaatgtagaaacggtctccaaagccaagggaaacctagagaaaatgtgccggactctagaggaccaactgagtgaactgaaatcaaaggaagaggagcagcagcggctgatcaatgacctgactgcgcagagggggcgcctgcagactgaatctggtgagttttcacgccagcttgatgaaaaggaagctctggtgtctcagttatcaagaggcaaacaagcctttactcaacagattgaagaattaaagaggcaacttgaagaggagataaaagccaagaacgccctggcgcatgccctgcagtcttcccgccacgactgtgacctgctgcgggaacagtatgaggaggagcaggaatccaaggccgagctgcagagagcactgtccaaggccaacaccgaggttgcccaatggaggaccaaatacgagacggacgccatccagcgcacagaggagctggaggaggccaagaagaagctggcccagcggctgcaggcagctgaggaacatgtagaagctgtgaacgccaaatgtgcttccctcgaaaagacgaagcagcggctgcagaatgaggtcgaggacctcatgcttgatgtggagaggacaaatgccgcctgtgccgcccttgacaaaaagcaaaggaacttcgataagatcctggcagaatggaaacagaaatgtgaggaaacgcatgctgagcttgaggcctcccagaaggaagcccgttcccttggcactgagctgttcaagataaagaatgcctatgaggaatctttggatcagctagaaaccctgaagcgagagaacaaaaacttacagcaggagatttctgacctcacggaacagattgcagaaggagggaaacgtatccatgaactggagaaaataaagaaacaagtggaacaagaaaagtgtgaacttcaggctgctttagaagaagcagaggcatctcttgaacatgaagagggaaagatcctgcgcatccagcttgagttgaaccaagtcaagtctgaggttgataggaaaattgctgaaaaagatgaggaaattgaccagctgaagagaaaccacattagaatcgtggagtccatgcagagcacgctggatgctgagatcaggagtaggaatgatgccattaggctcaagaagaagatggagggagacctcaatgaaatggaaatccagctgaaccatgccaaccgcatggctgctgaggccctgaggaactacaggaacacccaaggcatcctcaaggatacccagatccacctggatgatgctctccggagccaggaggacctgaaggaacagctggccatggtggagcgcagagccaacctgctgcaggctgagatcgaggagctgcgggccactctggaacagacagagaggagcagaaaaatcgcagaacaggagctcctggatgccagtgagcgtgttcagctactgcacacccagaacaccagcctgatcaacaccaagaagaagctggagacagatatttcccaaatgcaaggagagatggaggacattctccaggaagcccgcaatgcagaagaaaaggccaagaaggccatcactgatgccgccatgatggctgaggagctgaagaaggagcaggacaccagcgcccacctggagcggatgaagaagaacatggagcagaccgtgaaggatctgcagctccgtctggatgaggctgagcagctggccctgaagggtgggaagaagcagatccagaaactggaggccagggtacgggagctggaaggagaggttgagagtgagcaaaagcgtaatgctgaggctgtcaaaggtctgcgcaaacatgagaggcgagtgaaggaactcacttaccagacggaagaagatagaaagaatattctcaggcttcaagatttggtagataaacttcaggcaaaagtgaaatcttataagagacaagctgaggaggctgaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgcaaacaataaaaaaaaaaaag

SEQ ID NO: 361534 - DNA, 1650 bp, Homo sapiens
  misc_feature (10)..(10): n is a, c, g, or t
agctttgganaaatttattgaaacatacaggcggctgttagcagagaaatcatcctggcagaatggaaacagaaatgtgaggaaacgcatgctgagcttgaggcctcccagaaggaagcccgttcccttggcactgagctgttcaagataaagaatgcctatgaggaatctttggatcagctagaaaccctgaagcgagagaacaaaaacttacagcaggagatttctgacctcacggaacagattgcagaaggagggaaacgtatccatgaactggagaaaataaagaaacaagtggaacaagaaaagtgtgaacttcaggctgctttagaagaagcagaggcatctcttgaacatgaagagggaaagatcctgcgcatccagcttgagttgaaccaagtcaagtctgaggttgataggaaaattgctgaaaaagatgaggaaattgaccagctgaagagaaaccacattagaatcgtggagtccatgcagagcacgctggatgctgagatcaggagtaggaatgatgccattaggctcaagaagaagatggagggagacctcaatgaaatggaaatccagctgaaccatgccaaccgcatggctgctgaggccctgaggaactacaggaacacccaaggcatcctcaaggatacccagatccacctggatgatgctctccggagccaggaggacctgaaggaacagctggccatggtggagcgcagagccaacctgctgcaggctgagatcgaggagctgcgggccactctggaacagacagagaggagcagaaaaatcgcagaacaggagctcctggatgccagtgagcgtgttcagctactgcacacccagaacaccagcctgatcaacaccaagaagaagctggagacagatatttcccaaatgcaaggagagatggaggacattctccaggaagcccgcaatgcagaagaaaaggccaagaaggccatcactgatgccgccatgatggctgaggagctgaagaaggagcaggacaccagcgcccacctggagcggatgaagaagaacatggagcagaccgtgaaggatctgcagctccgtctggatgaggctgagcagctggccctgaagggtgggaagaagcagatccagaaactggaggccagggtacgggagctggaaggagaggttgagagtgagcaaaagcgtaatgctgaggctgtcaaaggtctgcgcaaacatgagaggcgagtgaaggaactcacttaccagacggaagaagatagaaagaatattctcaggcttcaagatttggtagataaacttcaggcaaaagtgaaatcttataagagacaagctgaggaggctgaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgcaaacaataaaaaaaaaaaag

SEQ ID NO: 361535 - DNA, 3172 bp, Homo sapiens
catggcggccgccagcggctacacggacctgcgtgagaagctcaagtccatgacgtcccgggacaactataaggcgggcagccgggaggccgccgccgctgccgcagccgccgtagccgccgcagccgcagccgccgctgccgccgaaccttaccctgtgtccggggccaagcgcaagtatcaggaggactcggaccccgagcgcagcgactatgaggagcagcagctgcagaaggaggaggaggcgcgcaaggtgaagagcggcatccgccagatgcgcctcttcagccaggacgagtgcgccaagatcgaggcccgcattgacgaggtggtgtcccgcgctgagaagggcctgtacaacgagcacacggtggaccgggccccactgcgcaacaagtacttcttcggcgaaggctacacttacggcgcccagctgcagaagcgcgggcccggccaggagcgcctctacccgccgggcgacgtggacgagatccccgagtgggtgcaccagctggtgatccaaaagctggtggagcaccgcgtcatccccgagggcttcgtcaacagcgccgtcatcaacgactaccagcccggcggctgcatcgtgtctcacgtggaccccatccacatcttcgagcgccccatcgtgtccgtgtccttctttagcgactctgcgctgtgcttcggctgcaagttccagttcaagcctattcgggtgtcggaaccagtgctttccctgccggtgcgcaggggaagcgtgactgtgctcagtggatatgctgctgatgaaatcactcactgcatacggcctcaggacatcaaggagcgccgagcagtcatcatcctcaggaagacaagattagatgcaccccggttggaaacaaagtccctgagcagctccgtgttaccacccagctatgcttcagatcgcctgtcaggaaacaacagggaccctgctctgaaacccaagcggtcccaccgcaaggcagaccctgatgctgcccacaggccacggatcctggagatggacaaggaagagaaccggcgctcggtgctgctgcccacacaccggcggaggggtagcttcagctctgagaactactggcgcaagtcatacgagtcctcagaggactgctctgaggcagcaggcagccctgcccgaaaggtgaagatgcggcggcactgagtctacccgccgccctcctgggaactctggctcatccttacgtagttgcccctccttttgttttgagggttttgtttttgttcattggggggtttttgttttttgttttttgttttttttgattctatatatttttccttggttttgttgcctgttaaggctgaagaatagaattggccaggacctaggttctcatattcttggtattcctcctggatggaaaggctgttggcatcaataggggacagaggctgatgctggagtggccagtagaggtggtggagcagagcagccatcttttaagtggggctgtatcaggctgggtttatttaaaagcaacaaaatgttttggttaagaaaattattttgctttcagtgtaaatcttcgcagtgttctaaacaaagttcagtcttctgctcgcccctttccctcactgatgtctgcacttggttgaggtctcctggagcctcacaggctctgctgttctccacttctcacctgccatccacgccctgcaagctcatgcaaacaccctttcttcctcctgcggcagagttgttcaggttgcctgggcaggggcttaaacagtgccagcccctgccatcccaaagctattgttaagccccccaggcgtcctccacccacgcccactagcctgccatgtccacagttccttgggctgctgaggggctagtgcagtggtcctgacctctcttatcaagagcacacttctttgctggttgctccttttgagcatatgcgtgtgattatttggaacagttagacttgccacgttgggtcagttttagaaattgtttctagctagagggactggtgtccttccaagtctagcatttggggtatggaaaattgttgtggtgtgtggtagggtttttgttttcttttttgagttttttttccccctttagtctcctggctttttcctttcccttcccttctccactggccagcttgggcctcatcctcatgtcatccttctaggaaggcgcctgccccatcttgtctgccggcagcatgcatccaaggccagagctcaggcctgcagactgggctggtgcctcctccgcttcagggtatgggagttggtgaaggggctttcaaaaaataataagaaaaaaaaggtaaagtctttggtagcttctatccactcagatcctggaaggcagcaaggttttgtggatctagattcattaggaatgtcttcttgtcagccaggccaggacccgggcttgccaagagcagaggccctcccagcaaccaggataccaccactttgggggctttgtgtacagaggtccgggtctgagacctcataggctgcagaaatctggggcagccaccatcaagaagcccctctcaggggccagaactcctttgccagcgtggatttctcaagtcgggactgcataattaaagcagttgcagttttattttttttacagcttttttcccaaaaatgatttgtagttgtgtgtgcagcacttcgccctgatatgtgtgctctacaataaaaaccaaatctaatatattttggaaacagttgtctgatgttgttgtaagagagggcttgcctttggtgcttccttaatccctttactttcttaaacttgaaacaggggttggggaggcagagctagctcattggccgccagcgtcccagaggagttggttggtcttggacactgggcctcctgtgtgcctagccttggatttatggctgaaggtggacttgccctcaccccactgtcctttctcccactccaaggagggtgaacttcataaaccacaatgtccaggtgcccagggaccacaccttctggagttctggaagtccctcttttagatatgatcactgagaggctggtgctggtgaagggggagatggcaggcacaaaagcaagggagaacctggcttttgtggaaaatatgcgagtgattttgctcattaaacaaatacttggcca

SEQ ID NO: 361536 - DNA, 1361 bp, Homo sapiens
  misc_feature (7)..(7): n is a, c, g, or t
  misc_feature (13)..(13): n is a, c, g, or t
  misc_feature (16)..(16): n is a, c, g, or t
gattctngagganccncacctcctaccccacgatcaagagcacacttctttgctggttgctccttttgagcatatgcgtgtgattatttggaacagttagacttgccacgttgggtcagttttagaaattgtttctagctagagggactggtgtccttccaagtctagcatttggggtatggaaaattgttgtggtgtgtggtagggtttttgttttcttttttgagttttttttccccctttagtctcctggctttttcctttcccttcccttctccactggccagcttgggcctcatcctcatgtcatccttctaggaaggcgcctgccccatcttgtctgccggcagcatgcatccaaggccagagctcaggcctgcagactgggctggtgcctcctccgcttcagggtatgggagttggtgaaggggctttcaaaaaataataagaaaaaaaaggtaaagtctttggtagcttctatccactcagatcctggaaggcagcaaggttttgtggatctagattcattaggaatgtcttcttgtcagccaggccaggacccgggcttgccaagagcagaggccctcccagcaaccaggataccaccactttgggggctttgtgtacagaggtccgggtctgagacctcataggctgcttgagattattcagctaggaaggccatcactgatgccgccatgatggctgaggagctgaagaaggagcaggacaccagcgcccacctggagcggatgaagaagaacatggagcagaccgtgaaggatctgcagctccgtctggatgaggctgagcagctggccctgaagggtgggaagaagcagatccagaaactggaggccagggtacgggagctggaaggagaggttgagagtgagcaaaagcgtaatgctgaggctgtcaaaggtctgcgcaaacatgagaggcgagtgaaggaactcacttaccagacggaagaagatagaaagaatattctcaggcttcaagatttggtagataaacttcaggcaaaagtgaaatcttataagagacaagctgaggaggctgaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgcaaacaataaaaaaaaaaaag

SEQ ID NO: 361537 - DNA, 2700 bp, Homo sapiens
catggcggccgccagcggctacacggacctgcgtgagaagctcaagtccatgacgtcccgggacaactataaggcgggcagccgggaggccgccgccgctgccgcagccgccgtagccgccgcagccgcagccgccgctgccgccgaaccttaccctgtgtccggggccaagcgcaagtatcaggaggactcggaccccgagcgcagcgactatgaggagcagcagctgcagaaggaggaggaggcgcgcaaggtgaagagcggcatccgccagatgcgcctcttcagccaggacgagtgcgccaagatcgaggcccgcattgacgaggtggtgtcccgcgctgagaagggcctgtacaacgagcacacggtggaccgggccccactgcgcaacaagtacttcttcggcgaaggctacacttacggcgcccagctgcagaagcgcgggcccggccaggagcgcctctacccgccgggcgacgtggacgagatccccgagtgggtgcaccagctggtgatccaaaagctggtggagcaccgcgtcatccccgagggcttcgtcaacagcgccgtcatcaacgactaccagcccggcggctgcatcgtgtctcacgtggaccccatccacatcttcgagcgccccatcgtgtccgtgtccttctttagcgactctgcgctgtgcttcggctgcaagttccagttcaagcctattcgggtgtcggaaccagtgctttccctgccggtgcgcaggggaagcgtgactgtgctcagtggatatgctgctgatgaaatcactcactgcatacggcctcaggacatcaaggagcgccgagcagtcatcatcctcaggaagacaagattagatgcaccccggttggaaacaaagtccctgagcagctccgtgttaccacccagctatgcttcagatcgcctgtcaggaaacaacagggaccctgctctgaaacccaagcggtcccaccgcaaggcagaccctgatgctgcccacaggccacggatcctggagatggacaaggaagagaaccggcgctcggtgctgctgcccacacaccggcggaggggtagcttcagctctgagaactactggcgcaagtcatacgagtcctcagaggactgctctgaggcagcaggcagccctgcccgaaaggtgaagatgcggcggcactgagtctacccgccgccctcctgggaactctggctcatccttacgtagttgcccctccttttgttttgagggttttgtttttgttcattggggggtttttgttttttgttttttgttttttttgattctatatatttttccttggttttgttgcctgttaaggctgaagaatagaattggccaggacctaggttctcatattcttggtattcctcctggatggaaaggctgttggcatcaataggggacagaggctgatgctggagtggccagtagaggtggtggagcagagcagccatcttttaagtggggctgtatcaggctgggtttatttaaaagcaacaaaatgttttggttaagaaaattattttgctttcagtgtaaatcttcgcagtgttctaaacaaagttcagtcttctgctcgcccctttccctcactgatgtctgcacttggttgaggtctcctggagcctcacaggctctgctgttctccacttctcacctgccatccacgccctgcaagctcatgcaaacaccctttcttcctcctgcggcagagttgttcaggttgcctgggcaggggcttaaacagtgccagcccctgccatcccaaagctattgttaagccccccaggcgtcctccacccacgcccactagcctgccatgtccacagttccttgggctgctgaggggctagtgcagtggtcctgacctctcttatcaagagcacacttctttgctggttgctccttttgagcatatgcgtgtgattatttggaacagttagacttgccacgttgggtcagttttagaaattgtttctagctagagggactggtgtccttccaagtctagcatttggggtatggaaaattgttgtggtgtgtggtagggtttttgttttcttttttgagttttttttccccctttagtctcctggctttttcctttcccttcccttctccactggccagcttgggcctcatcctcatgtcatccttctaggaaggcgcctgccccatcttgtctgccggcagcatgcatccaaggccagagctcaggcctgcagactgggctggtgcctcctccgcttcagggtatgggagttggtgaaggggctttcaaaaaataataagaaaaggttttgtggatctagattcattaggaatgtcttcttgtcagccaggccaggacccgggcttgccaagagcagaggccctcccagcaaccaggataccaccactttgggggctttgtgtacagaggtccgggtctgagacctcataggctgcagaaatctggggcagccaccatcaagaagcccctctcaggggccagaactcctttgccagcgtggatttctcaagtcgggactgcataattaaagcagttgcagttttattttttttacagcttttttcccaaaaatgatttgtagttgtgtgtgcagcacttcatcctcgattgcgcgctataccactttaacccactctcctcttctctacacattctcccg

SEQ ID NO: 361538 - DNA, 4991 bp, Homo sapiens
gaggacgggcctttcaagagggacactggtcacaccgcccagtgtcagcagcagctgctagttctgaactgtctcactcccaggctacatcttctcacttgctaacaaggacctctgagttcagcagccatgagttcagactcagaattggctgtttttggggaggctgctcctttcctccgaaagtctgaaagggagcgcattgaggcccagaataggccctttgatgccaaaacatctgtctttgtggcggagcccaaagaatcctttgtcaaagggaccatccagagcagagaaggaggaaaagtgacggtgaagactgagggaggagcgactctgacagtgaaggatgatcaggtcttccccatgaaccctcccaaatatgacaagatcgaggatatggccatgatgactcatctgcatgagcctgctgtgctgtacaacctcaaagaacgttatgcagcctggatgatctacacctattcaggtctcttctgtgtcactgtcaacccctacaagtggctgcctgtgtataagcccgaggtggtgacagcctaccgaggcaaaaagcgccaggaggccccgccccacatcttctccatctctgacaacgcctatcagttcatgctgactgaccgagagaatcagtcaatcctgatcactggagaatctggtgcagggaagactgtgaacaccaagcgtgtcatccagtactttgcaacaattgcagttactggtgagaagaagaaggaagaaattacttctggcaaaatacaggggactctggaagatcaaatcatcagtgccaaccccctactggaggcctttggcaacgccaagaccgtgaggaatgacaactcctctcgctttggtaaattcatcagaatccactttggcactactggaaaactggcatctgctgatattgaaacatatctgctagagaagtctagagttgttttccagcttaaggctgagagaagttatcatattttttaccagattacatcgaataagaaaccagaacttattgaaatgcttctgattaccacgaacccatatgattacccatttgtcagtcaaggggagatcagtgtggccagcatcgatgatcaggaagaactgatggccacagatagtgctattgatattttgggctttactaatgaagaaaaggtctccatttacaagctcacgggggctgtgatgcattatgggaacctaaaatttaagcaaaagcagcgtgaggagcaagcagagccagatggcacagaagttgctgacaaggcggcctacctccagagtctgaactctgcagatctgctcaaagctctctgctaccccagggtcaaggtcggcaatgagtatgtcaccaaaggccagactgtagaacaggtgtccaacgcagtaggtgctctggccaaagccgtctacgagaagatgttcctgtggatggttgcccgcatcaaccagcagctggacaccaagcagcccaggcagtacttcatcggggtcttggacattgctggttttgagatttttgatttcaacagcctggagcagctgtgcatcaacttcaccaatgagaaactgcaacagtttttcaaccaccacatgttcgtgctggagcaggaggagtacaagaaggaaggcatcgagtggacgttcatcgacttcgggatggacctggctgcctgcatcgagctcatcgagaaggttggtcctatgggcatcttctccatcctggaagaggagtgcatgttccctaaggcaacagacacctccttcaagaacaagctgtatgaccagcacctgggcaagtctgccaacttccagaagcccaaggtggtcaaaggcaaggccgaggcccacttcgctctgattcactatgctggtgttgtggactacaacattactggctggctggagaagaacaaggaccccctgaatgagaccgtggttggactgtaccagaagtctgcaatgaaaactctagctcagctcttctctggggctcaaactgctgaaggagagggagctggtggaggggccaagaaaggtggtaagaagaagggctcttctttccagacagtgtctgcccttttcagagagaatttgaacaagctgatgaccaacctcaggagtacccatcctcactttgtgaggtgtatcatccccaatgagacaaaaactcctggtgccatggagcatgagcttgtcctccaccagctgaggtgtaacggtgtgctggaaggcatccgcatctgtaggaaaggatttccaagcagaatcctttatgcagacttcaaacagagatacaaggtattaaatgcaagtgcaatccctgaagggcaattcattgatagcaagaaggcctctgagaagctccttgcatccatcgacattgaccacacccagtataaatttgggcacaccaaggtctttttcaaagctggtcttctggggctcctagaggagatgcgagatgacaagctggcccagctgattacccgaacccaggccaggtgcagagggttcttggcaagagtggagtaccagaggatggtggagagaagggaggccatcttctgtatccagtacaatatcagatccttcatgaatgtcaagcactggccctggatgaaactcttcttcaagatcaagcctctgttgaagagtgcagaaactgagaaggagatggccaccatgaaggaagaatttcagaaaattaaagacgaacttgccaagtcagaggcaaaaaggaaggaactggaagaaaagatggtgacgctgttgaaagaaaaaaatgacttgcagctccaagttcaggctgaagccgaaggcttggctgatgcagaggaaaggtgtgaccagctaatcaaaaccaaaatccagctagaagccaaaatcaaagaggtgactgagagagctgaggatgaggaagagatcaatgctgagctgacagccaagaagaggaaactggaggatgaatgttcagaactcaagaaagacattgatgaccttgagctgacactggccaaggttgagaaggagaaacatgccacagaaaacaaggtgaaaaacctcacagaagagatggcaggtctggatgaaaccattgctaagctgaccaaggagaagaaggctctccaggaggcccaccagcagaccctggatgacctgcaggcagaggaggacaaagtcaacaccctgaccaaagctaaaatcaaacttgaacaacaagtggatgatcttgaagggtccttggagcaagaaaagaaacttcgcatggacctagaaagggctaagaggaaacttgagggtgacttgaagttggcccaagaatccataatggacattgaaaatgagaaacagcaacttgatgaaaagctcaaaaagaaagagtttgaaatcagcaatctgcaaagcaagattgaagatgaacaggcacttggcattcaattgcagaagaaaattaaagaattgcaagcccgcattgaggagctggaggaggaaatcgaggcggagcgggcctcccgggccaaagcagagaagcagcgctctgacctctcccgggagctggaggagatcagcgagaggctggaagaagccggtggggccacttcagcccagattgagatgaacaagaagcgggaggctgagttccagaaaatgcgcagggacctggaggaggccaccctacagcatgaagccacagcggccaccctgaggaagaagcatgcagatagtgtggccgagcttggggagcagattgacaacctgcagcgagtgaagcagaagctggagaaggagaagagtgagatgaagatggagattgatgaccttgctagtaatgtagaaacggtctccaaagccaagggaaacctagagaaaatgtgccggactctagaggaccaactgagtgaactgaaatcaaaggaagaggagcagcagcggctgatcaatgacctgactgcgcagagggggcgcctgcagactgaatctggtgagttttcacgccagcttgatgaaaaggaagctctggtgtctcagttatcaagaggcaaacaagcctttactcaacagattgaagaattaaagaggcaacttgaagaggagataaaagccaagaacgccctggcgcatgccctgcagtcttcccgccacgactgtgacctgctgcgggaacagtatgaggaggagcaggaatccaaggccgagctgcagagagcactgtccaaggccaacaccgaggttgcccaatggaggaccaaatacgagacggacgccatccagcgcacagaggagctggaggaggccaagaagaagctggcccagcggctgcaggcagctgaggaacatgtagaagctgtgaacgccaaatgtgcttccctcgaaaagacgaagcagcggctgcagaatgaggtcgaggacctcatgcttgatgtggagaggacaaatgccgcctgtgccgcccttgacaaaaagcaaaggaacttcgataagatcctggcagaatggaaacagaaatgtgaggaaacgcatgctgagcttgaggcctcccagaaggaagcccgttcccttggcactgagctgttcaagataaagaatgcctatgaggaatctttggatcagctagaaaccctgaagcgagagaacaaaaacttacagcaggagatttctgacctcacggaacagattgcagaaggagggaaacgtatccatgaactggagaaaataaagaaacaagtggaacaagaaaagtgtgaacttcaggctgctttagaagaagcagagtgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgcaaacaataaaaaaaaaaaag

SEQ ID NO: 361539 - DNA, 2934 bp, Homo sapiens
gaggacgggcctttcaagagggacactggtcacaccgcccagtgtcagcagcagctgctagttctgaactgtctcactcccaggctacatcttctcacttgctaacaaggacctctgagttcagcagccatgagttcagactcagaattggctgtttttggggaggctgctcctttcctccgaaagtctgaaagggagcgcattgaggcccagaataggccctttgatgccaaaacatctgtctttgtggcggagcccaaagaatcctttgtcaaagggaccatccagagcagagaaggaggaaaagtgacggtgaagactgagggaggagcgactctgacagtgaaggatgatcaggtcttccccatgaaccctcccaaatatgacaagatcgaggatatggccatgatgactcatctgcatgagcctgctgtgctgtacaacctcaaagaacgttatgcagcctggatgatctacacctattcaggtctcttctgtgtcactgtcaacccctacaagtggctgcctgtgtataagcccgaggtggtgacagcctaccgaggcaaaaagcgccaggaggccccgccccacatcttctccatctctgacaacgcctatcagttcatgctgactgaccgagagaatcagtcaatcctgatcactggagaatctggtgcagggaagactgtgaacaccaagcgtgtcatccagtactttgcaacaattgcagttactggtgagaagaagaaggaagaaattacttctggcaaaatacaggggactctggaagatcaaatcatcagtgccaaccccctactggaggcctttggcaacgccaagaccgtgaggaatgacaactcctctcgctttggtaaattcatcagaatccactttggcactactggaaaactggcatctgctgatattgaaacatatctgctagagaagtctagagttgttttccagcttaaggctgagagaagttatcatattttttaccagattacatcgaataagaaaccagaacttattgaaatgcttctgattaccacgaacccatatgattacccatttgtcagtcaaggggagatcagtgtggccagcatcgatgatcaggaagaactgatggccacagatagtgctattgatattttgggctttactaatgaagaaaaggtctccatttacaagctcacgggggctgtgatgcattatgggaacctaaaatttaagcaaaagcagcgtgaggagcaagcagagccagatggcacagaagttgctgacaaggcggcctacctccagagtctgaactctgcagatctgctcaaagctctctgctaccccagggtcaaggtcggcaatgagtatgtcaccaaaggccagactgtagaacaggtgtccaacgcagtaggtgctctggccaaagccgtctacgagaagatgttcctgtggatggttgcccgcatcaaccagcagctggacaccaagcagcccaggcagtacttcatcggggtcttggacattgctggttttgagatttttgatttcaacagcctggagcagctgtgcatcaacttcaccaatgagaaactgcaacagtttttcaaccaccacatgttcgtgctggagcaggaggagtacaagaaggaaggcatcgagtggacgttcatcgacttcgggatggacctggctgcctgcatcgagctcatcgagaaggttggtcctatgggcatcttctccatcctggaagaggagtgcatgttccctaaggcaacagacacctccttcaagaacaagctgtatgaccagcacctgggcaagtctgccaacttccagaagcccaaggtggtcaaaggcaaggccgaggcccacttcgctctgattcactatgctggtgttgtggactacaacattactggctggctggagaagaacaaggaccccctgaatgagaccgtggttggactgtaccagaagtctgcaatgaaaactctagctcagctcttctctggggctcaaactgctgaaggagagggagctggtggaggggccaagaaaggtggtaagaagaagggctcttctttccagacagtgtctgcccttttcagagagaatttgaacaagctgatgaccaacctcaggagtacccatcctcactttgtgaggtgtatcatccccaatgagacaaaaactcctggtgccatggagcatgagcttgtcctccaccagctgaggtgtaacggtgtgctggaaggcatccgcatctgtaggaaaggatttccaagcagaatcctttatgcagacttcaaacagagatacaaggtattaaatgcaagtgcaatccctgaagggcaattcattgatagcaagaaggcctctgagaagctccttgcatccatcgacattgaccacacccagtataaatttgggcacaccaaggtctttttcaaagctggtcttctggggctcctagaggagatgcgagatgacaagctggcccagctgattacccgaacccaggccaggtgcagagggttcttggcaagagtggagtaccagaggatggtggagagaagggaggccatcttctgtatccagtacaatatcagatccttcatgaatgtcaagcactggccctggatgaaactcttcttcaagatcaagcctctgttgaagagtgcagaaactgagaaggagatggccaccatgaaggaagaatttcagaaaattaaagacgaacttgccaagtcagaggcaaaaaggaaggaactggaagaaaagatggtgacgctgttgaaagaaaaaaatgacttgcagctccaagttcaggctgaagccgaaggcttggctgatgcagaggaaagttggaccagcatagcaaaccatagccatgcagagccttaaacaagatgggtcgagagatcgagactactt

SEQ ID NO: 361540 - DNA, 1326 bp, Homo sapiens
ctcacctctacaccttcccctcatcacctgaatgaaaaacagaccgcccttcactccttccatctgaaggacgtcctcactaccatcggggagaaggtgtgcctggaggtgagcagctgcctctccctgtgtgggtcctctcccttcaccacggacaaggagaccgtgctcaagggccagatccaggccgtggccagtcccgatgaccccattcgcaggatcatggaatctcgaatcctgaccttcttagaaacctaccttgcctcgggtcatcagaagccattgcccacagtccctgggggactcagtccagttcagagagagctggaggaagttgctattaaatttgctcgcctggtcaactataacaagatggtcttctgtccctactacgatgcaatcctgagtaagatcctcgtccgatcctaacgtgtatgcaccctacagcagcagtattactcactagccacagaatacctgttctgtactctaatgttgcattggaaaatggctatatagtacatgtctatttaacagcaccgattccaaagggaagaatattgtgtatcactgttgaaaagacttgttgagaaatccactgaattctattttgagagattgtatttatgagtgcaagtttacaaatcaaagaagcattttgttctcgagttttacaggtaacactcagctgttgtctccactcctcccccatcatgtccttccaaggaggctgggacctctctcttctgcaatctgggtagttctttcagatgcctcatgctgagctgacggccatccaagcgcaaaagagaccaagccatggcctcacctcctgccctccctcagacagccttgtccctcacccctcccttctggtatttttgttagaagggctatataacgtcttattgccattttctccccctatttattgcttcctccctgcctggcctagccagggctcccaagcccttttttctagaggagagttatttgtctctctctctttttttttttactttcttttttgtatttaaacattcttttaaccttcccccaaagatacagttattggactttaaaaagcttgttcttttatacaaaattactcctgcatctggttgagagcagttatgacttatgagatctagtgaaaggaaagtctttgactttcaagccttgaaagtcaaggaggaaatgtattgaaaaatagtttactgtaatgtgaacgaagagaaatgtctggaattcttactgaaaaattgaccctgagacaatacacagatgtgatgattgaattaaattctggaattagatttaactgtt

SEQ ID NO: 361541 - DNA, 419 bp, Homo sapiens
gcaaaaaatcactaacttttaaaataaagtatgccctcagttgaagtatgcctgggaaatctttccttggtccaaatcactgggattgatcttaccctaaacccatagtatttgtgcttttgaaagtgatttgaaactcaaatattttggtttttgcccccctccttttttttttcactgccccagcttgaagaagagagtaaaggagattgtacataaagcgttttgggattgcttgagtgtgcagctaagtgaagatcccccagcatatgaccatgctatcaaacttgtaggagaaatcaaagaggtgaggcaaagagtgaattgtgatgcttttctggtgtgttaggagtgtttattcaacttcttgtgtcaccaccagaagactttaaagaaattgaaggatcaagaagttaaag

SEQ ID NO: 361542 - DNA, 2819 bp, Homo sapiens
  misc_feature (2214)..(2214): n is a, c, g, or t
  misc_feature (2330)..(2330): n is a, c, g, or t
  misc_feature (2717)..(2717): n is a, c, g, or t
ggaccgcccgccgcgtggcgagggatgcggcctcggaggggcagaggctgaaccgcccctgcctgccgcgcatccctccggcttccgccgcggcgccagcccgcgcctgattcgcggcgggagcggcaggagggagaacgccgactccgtggcaggtgagagcgggagctggggcggaggctggcggggcccgtccgggaggcgcgcggtccaagtcgcacgcatctcttcgcctcttcccgtcggatcccatcccgggatgtcgggggcaggcgaggaagaggcggggtccgcgggcgggtggagctcacccctcgaggctgtcctctcggcgcgcccgcgtcctcccctactcccggccctgccactccctcgctggcctgaacagctgtttacaacggaatccggacgccgggcgcgagtggagctcagtgccagaggaggggattcccggcgccgggggacagagcccctttttttcttttgccgaaagaccctttctgctggggagcctcttgtgtccagcctaggcccgcgtgcagcgccgacggatgatcgtcttcttggcgaaagtgaataaacttaattgagaatgtctgaaaaccttgacaagtccaatgtaaatgaagcaggaaaatcaaaatccaatgattctgaggaaggccttgaagatgctgtggaaggtgctgatgaagccttacaaaaagcaataaagtcagactcctccagcccccaaagagtgcagagacctcactctagtcctcctcgctttgtgacagtagaagaacttctagagacagcgagaggcgtcaccaacatggctctagcccatgaaattgtagtaaatggagactttcagattaaaccagttgaattaccagaaaacagcttgaagaagagagtaaaggagattgtacataaagcgttttgggattgcttgagtgtgcagctaagtgaagatcccccagcatatgaccatgctatcaaacttgtaggagaaatcaaagagactctcttatctttcttgctgcctggtcatactagactgagaaaccagataacagaagtcttggatctggatctgataaagcaggaagcagagaatggggcgctagacatttccaagctggcagaattcattattggcatgatggggacactgtgtgcacctgctcgagatgaggaagttaagaaactaaaggacattaaggaaatagtgccccttttcagagaaattttttctgtgttggacctaatgaaagtggacatggccaactttgctatcagtagcatcaggcctcatctcatgcagcagtcagttgaatacgaaaggaagaagtttcaagagattttggagaggcaaccaaattccctggactttgtcacccagtggctggaagaagcctcagaggaccttatgactcagaagtataaacacgccctgccagtggggggaatggctgctggctctggggacatgcccaggctgagccctgttgctgtccagaattacgcttacctgaagcttctgaagtgggaccacctccagaggccgttccccgaaacagttttaatggaccagtctcgcttccacgagctccagttgcagctggaacaactgaccatcctgggggctgtgttgctggtcaccttcagcatggcagcgccaggaatttccagccaggccgactttgctgagaaactcaagatgattgtgaagattttgctaacagatatgcacctgccctccttccatctgaaggacgtcctcactaccatcggggagaaggtgtgcctggaggtgagcagctgcctctccctgtgtgggtcctctcccttcaccacggacaaggagaccgtgctcaagggccagatccaggccgtggccagtcccgatgaccccattcgcaggatcatggaatctcgaatcctgaccttcttagaaacctaccttgcctcgggtcatcagaagccattgcccacagtccctgggggactcagtccagttcagagagagctggaggaagttgctattaaatttgctcgcctggtcaactataacaagatggtcttctgtccctactacgatgcaatcctgagaaaaagatggatatcttttggcaatttctttgggtccagcaatactgatatgagtccttggaattgtaggactgattatcccatgagtctgcacattagatttccaaagaaccntgtgatagaggcaccaatgacaatacaactttgtttccaagaaccttgtaacaaagcgttgtctcttttaaacataccacttgaggcaaaaggaatcctggacaggagttttctgnagaggcgtttaaaaccctaccgaatccgcttctgctgccgtgctctgtaaatgtcatgaacaggggggacaacggctcccttttcttcatcttcatctgaatcctcgttgggccttttgacggccttgtctctccagagctgttcaatgttgatcatcggattaacacaacctcgttgataaactcttcggacagctgttattctttgattttctgcataagatcctacagcttccctgagattggataagaaatgccatcaattatattataaccaaatctcattcaacccagcaatctcactactggatatctacccaaagaacaactctatggaaaatagtatggagatttctcaaagaactaaaaattatattttagctaaancaactgtagatgtaaaaaaaaactatacaaatacttacacgccttttaggaaattgatgtaatccacccaaatctaagaaataaaatgaaatgttaatatct

SEQ ID NO: 361543 - DNA, 2117 bp, Homo sapiens
  misc_feature (1512)..(1512): n is a, c, g, or t
  misc_feature (1628)..(1628): n is a, c, g, or t
  misc_feature (2015)..(2015): n is a, c, g, or t
gcaaaaaatcactaacttttaaaataaagtatgccctcagttgaagtatgcctgggaaatctttccttggtccaaatcactgggattgatcttaccctaaacccatagtatttgtgcttttgaaagtgatttgaaactcaaatattttggtttttgcccccctccttttttttttcactgccccagcttgaagaagagagtaaaggagattgtacataaagcgttttgggattgcttgagtgtgcagctaagtgaagatcccccagcatatgaccatgctatcaaacttgtaggagaaatcaaagagactctcttatctttcttgctgcctggtcatactagactgagaaaccagataacagaagtcttggatctggatctgataaagcaggaagcagagaatggggcgctagacatttccaagctggcagaattcattattggcatgatggggacactgtgtgcacctgctcgagatgaggaagttaagaaactaaaggacattaaggaaatagtgccccttttcagagaaattttttctgtgttggacctaatgaaagtggacatggccaactttgctatcagtagcatcaggcctcatctcatgcagcagtcagttgaatacgaaaggaagaagtttcaagagattttggagaggcaaccaaattccctggactttgtcacccagtggctggaagaagcctcagaggaccttatgactcagaagtataaacacgccctgccagtggggggaatggctgctggctctggggacatgcccaggctgagccctgttgctgtccagaattacgcttacctgaagcttctgaagtgggaccacctccagaggccgttccccgaaacagttttaatggaccagtctcgcttccacgagctccagttgcagctggaacaactgaccatcctgggggctgtgttgctggtcaccttcagcatggcagcgccaggaatttccagccaggccgactttgctgagaaactcaagatgattgtgaagattttgctaacagatatgcacctgccctccttccatctgaaggacgtcctcactaccatcggggagaaggtgtgcctggaggtgagcagctgcctctccctgtgtgggtcctctcccttcaccacggacaaggagaccgtgctcaagggccagatccaggccgtggccagtcccgatgaccccattcgcaggatcatggaatctcgaatcctgaccttcttagaaacctaccttgcctcgggtcatcagaagccattgcccacagtccctgggggactcagtccagttcagagagagctggaggaagttgctattaaatttgctcgcctggtcaactataacaagatggtcttctgtccctactacgatgcaatcctgagaaaaagatggatatcttttggcaatttctttgggtccagcaatactgatatgagtccttggaattgtaggactgattatcccatgagtctgcacattagatttccaaagaaccntgtgatagaggcaccaatgacaatacaactttgtttccaagaaccttgtaacaaagcgttgtctcttttaaacataccacttgaggcaaaaggaatcctggacaggagttttctgnagaggcgtttaaaaccctaccgaatccgcttctgctgccgtgctctgtaaatgtcatgaacaggggggacaacggctcccttttcttcatcttcatctgaatcctcgttgggccttttgacggccttgtctctccagagctgttcaatgttgatcatcggattaacacaacctcgttgataaactcttcggacagctgttattctttgattttctgcataagatcctacagcttccctgagattggataagaaatgccatcaattatattataaccaaatctcattcaacccagcaatctcactactggatatctacccaaagaacaactctatggaaaatagtatggagatttctcaaagaactaaaaattatattttagctaaancaactgtagatgtaaaaaaaaactatacaaatacttacacgccttttaggaaattgatgtaatccacccaaatctaagaaataaaatgaaatgttaatatct

SEQ ID NO: 361544 - DNA, 1983 bp, Homo sapiens
tcccacctcagcctcctaaagtgctgggattacaggcatgagccaccatgcctggcttattcattatcttgtttaatcctcacaacagcctgtgaggtgggtgttgtaaatttgcctatatcaggcatctgaaactcagacacattatgacttgcctgagatccctcagttagtcattggcactactatgatttgatccaagttttatttgattccaaagttcatactttatactttatcactccaccaggacatcgattgtcccttaagtaattccgagaagcatcccttcttggtgtcaaggtaatgtgtgcagctttgtttttcacagattccctggactttgtcacccagtggctggaagaagcctcagaggaccttatgactcagaagtataaacacgccctgccagtggggggaatggctgctggctctggggacatgcccaggctgagccctgttgctgtccagaattacgcttacctgaagcttctgaagtgggaccacctccagaggccgttccccgaaacagttttaatggaccagtctcgcttccacgagctccagttgcagctggaacaactgaccatcctgggggctgtgttgctggtcaccttcagcatggcagcgccaggaatttccagccaggccgactttgctgagaaactcaagatgattgtgaagattttgctaacagatatgcacctgccctccttccatctgaaggacgtcctcactaccatcggggagaaggtgtgcctggaggtgagcagctgcctctccctgtgtgggtcctctcccttcaccacggacaaggagaccgtgctcaagggccagatccaggccgtggccagtcccgatgaccccattcgcaggatcatggaatctcgaatcctgaccttcttagaaacctaccttgcctcgggtcatcagaagccattgcccacagtccctgggggactcagtccagttcagagagagctggaggaagttgctattaaatttgctcgcctggtcaactataacaagatggtcttctgtccctactacgatgcaatcctgagtaagatcctcgtccgatcctaacgtgtatgcaccctacagcagcagtattactcactagccacagaatacctgttctgtactctaatgttgcattggaaaatggctatatagtacatgtctatttaacagcaccgattccaaagggaagaatattgtgtatcactgttgaaaagacttgttgagaaatccactgaattctattttgagagattgtatttatgagtgcaagtttacaaatcaaagaagcattttgttctcgagttttacaggtaacactcagctgttgtctccactcctcccccatcatgtccttccaaggaggctgggacctctctcttctgcaatctgggtagttctttcagatgcctcatgctgagctgacggccatccaagcgcaaaagagaccaagccatggcctcacctcctgccctccctcagacagccttgtccctcacccctcccttctggtatttttgttagaagggctatataacgtcttattgccattttctccccctatttattgcttcctccctgcctggcctagccagggctcccaagcccttttttctagaggagagttatttgtctctctctctttttttttttactttcttttttgtatttaaacattcttttaaccttcccccaaagatacagttattggactttaaaaagcttgttcttttatacaaaattactcctgcatctggttgagagcagttatgacttatgagatctagtgaaaggaaagtctttgactttcaagccttgaaagtcaaggaggaaatgtattgaaaaatagtttactgtaatgtgaacgaagagaaatgtctggaattcttactgaaaaattgaccctgagacaatacacagatgtgatgattgaattaaattctggaattagatttaactgtt

SEQ ID NO: 361545 - DNA, 413 bp, Homo sapiens
taagaggtgatggttaagctaagaactgaagcacagtaaggtttgtaaggtgaaggacaagaaacaactgaccactttcttttttgtcacagaatctcgaatcctgaccttcttagaaacctaccttgcctcgggtcatcagaagccattgcccacagtccctgggggactcagtccagttcagagagagctggaggaagttgctattaaatttgctcgcctggtcaactataacaagatggtcttctgtccctactacgatgcaatcctgagtaagatcctcgtccgatcctaacgtgtatgcaccctacagcagcagtattactcactagccacagaatacctgttctgtactctaatgttgcattggaaaatggctatatagtacatgtctatttaacagcaccgattcc

SEQ ID NO: 361546 - DNA, 3019 bp, Homo sapiens
ggaccgcccgccgcgtggcgagggatgcggcctcggaggggcagaggctgaaccgcccctgcctgccgcgcatccctccggcttccgccgcggcgccagcccgcgcctgattcgcggcgggagcggcaggagggagaacgccgactccgtggcaggtgagagcgggagctggggcggaggctggcggggcccgtccgggaggcgcgcggtccaagtcgcacgcatctcttcgcctcttcccgtcggatcccatcccgggatgtcgggggcaggcgaggaagaggcggggtccgcgggcgggtggagctcacccctcgaggctgtcctctcggcgcgcccgcgtcctcccctactcccggccctgccactccctcgctggcctgaacagctgtttacaacggaatccggacgccgggcgcgagtggagctcagtgccagaggaggggattcccggcgccgggggacagagcccctttttttcttttgccgaaagaccctttctgctggggagcctcttgtgtccagcctaggcccgcgtgcagcgccgacggatgatcgtcttcttggcgaaagtgaataaacttaattgagaatgtctgaaaaccttgacaagtccaatgtaaatgaagcaggaaaatcaaaatccaatgattctgaggaaggccttgaagatgctgtggaaggtgctgatgaagccttacaaaaagcaataaagtcagactcctccagcccccaaagagtgcagagacctcactctagtcctcctcgctttgtgacagtagaagaacttctagagacagcgagaggcgtcaccaacatggctctagcccatgaaattgtagtaaatggagactttcagattaaaccagttgaattaccagaaaacagcttgaagaagagagtaaaggagattgtacataaagcgttttgggattgcttgagtgtgcagctaagtgaagatcccccagcatatgaccatgctatcaaacttgtaggagaaatcaaagagactctcttatctttcttgctgcctggtcatactagactgagaaaccagataacagaagtcttggatctggatctgataaagcaggaagcagagaatggggcgctagacatttccaagctggcagaattcattattggcatgatggggacactgtgtgcacctgctcgagatgaggaagttaagaaactaaaggacattaaggaaatagtgccccttttcagagaaattttttctgtgttggacctaatgaaagtggacatggccaactttgctatcagtagcatcaggcctcatctcatgcagcagtcagttgaatacgaaaggaagaagtttcaagagattttggagaggcaaccaaattccctggactttgtcacccagtggctggaagaagcctcagaggaccttatgactcagaagtataaacacgccctgccagtggggggaatggctgctggctctggggacatgcccaggctgagccctgttgctgtccagaattacgcttacctgaagcttctgaagtgggaccacctccagaggccgttccccgaaacagttttaatggaccagtctcgcttccacgagctccagttgcagctggaacaactgaccatcctgggggctgtgttgctggtcaccttcagcatggcagcgccaggaatttccagccaggccgactttgctgagaaactcaagatgattgtgaagattttgctaacagatatgcacctgccctccttccatctgaaggacgtcctcactaccatcggggagaaggtgtgcctggaggtgagcagctgcctctccctgtgtgggtcctctcccttcaccacggacaaggagaccgtgctcaagggccagatccaggccgtggccagtcccgatgaccccattcgcaggatcatggaatctcgaatcctgaccttcttagaaacctaccttgcctcgggtcatcagaagccattgcccacagtccctgggggactcagtccagttcagagagagctggaggaagttgctattaaatttgctcgcctggtcaactataacaagatggtcttctgtccctactacgatgcaatcctgagtaagatcctcgtccgatcctaacgtgtatgcaccctacagcagcagtattactcactagccacagaatacctgttctgtactctaatgttgcattggaaaatggctatatagtacatgtctatttaacagcaccgattccaaagggaagaatattgtgtatcactgttgaaaagacttgttgagaaatccactgaattctattttgagagattgtatttatgagtgcaagtttacaaatcaaagaagcattttgttctcgagttttacaggtaacactcagctgttgtctccactcctcccccatcatgtccttccaaggaggctgggacctctctcttctgcaatctgggtagttctttcagatgcctcatgctgagctgacggccatccaagcgcaaaagagaccaagccatggcctcacctcctgccctccctcagacagccttgtccctcacccctcccttctggtatttttgttagaagggctatataacgtcttattgccattttctccccctatttattgcttcctccctgcctggcctagccagggctcccaagcccttttttctagaggagagttatttgtctctctctctttttttttttactttcttttttgtatttaaacattcttttaaccttcccccaaagatacagttattggactttaaaaagcttgttcttttatacaaaattactcctgcatctggttgagagcagttatgacttatgagatctagtgaaaggaaagtctttgactttcaagccttgaaagtcaaggaggaaatgtattgaaaaatagtttactgtaatgtgaacgaagagaaatgtctggaattcttactgaaaaattgaccctgagacaatacacagatgtgatgattgaattaaattctggaattagatttaactgtt

SEQ ID NO: 361547 - DNA, 2406 bp, Homo sapiens
  misc_feature (1801)..(1801): n is a, c, g, or t
  misc_feature (1917)..(1917): n is a, c, g, or t
  misc_feature (2304)..(2304): n is a, c, g, or t
ggaccgcccgccgcgtggcgagggatgcggcctcggaggggcagaggctgaaccgcccctgcctgccgcgcatccctccggcttccgccgcggcgccagcccgcgcctgattcgcggcgggagcggcaggagggagaacgccgactccgtggcaggaaagtgaataaacttaattgagaatgtctgaaaaccttgacaagtccaatgtaaatgaagcaggaaaatcaaaatccaatgattctgaggaaggccttgaagatgctgtggaaggtgctgatgaagccttacaaaaagcaataaagtcagactcctccagcccccaaagagtgcagagacctcactctagtcctcctcgctttgtgacagtagaagaacttctagagacagcgagaggcgtcaccaacatggctctagcccatgaaattgtagtaaatggagactttcagattaaaccagttgaattaccagaaaacagcttgaagaagagagtaaaggagattgtacataaagcgttttgggattgcttgagtgtgcagctaagtgaagatcccccagcatatgaccatgctatcaaacttgtaggagaaatcaaagagactctcttatctttcttgctgcctggtcatactagactgagaaaccagataacagaagtcttggatctggatctgataaagcaggaagcagagaatggggcgctagacatttccaagctggcagaattcattattggcatgatggggacactgtgtgcacctgctcgagatgaggaagttaagaaactaaaggacattaaggaaatagtgccccttttcagagaaattttttctgtgttggacctaatgaaagtggacatggccaactttgctatcagtagcatcaggcctcatctcatgcagcagtcagttgaatacgaaaggaagaagtttcaagagattttggagaggcaaccaaattccctggactttgtcacccagtggctggaagaagcctcagaggaccttatgactcagaagtataaacacgccctgccagtggggggaatggctgctggctctggggacatgcccaggctgagccctgttgctgtccagaattacgcttacctgaagcttctgaagtgggaccacctccagaggccgttccccgaaacagttttaatggaccagtctcgcttccacgagctccagttgcagctggaacaactgaccatcctgggggctgtgttgctggtcaccttcagcatggcagcgccaggaatttccagccaggccgactttgctgagaaactcaagatgattgtgaagattttgctaacagatatgcacctgccctccttccatctgaaggacgtcctcactaccatcggggagaaggtgtgcctggaggtgagcagctgcctctccctgtgtgggtcctctcccttcaccacggacaaggagaccgtgctcaagggccagatccaggccgtggccagtcccgatgaccccattcgcaggatcatggaatctcgaatcctgaccttcttagaaacctaccttgcctcgggtcatcagaagccattgcccacagtccctgggggactcagtccagttcagagagagctggaggaagttgctattaaatttgctcgcctggtcaactataacaagatggtcttctgtccctactacgatgcaatcctgagaaaaagatggatatcttttggcaatttctttgggtccagcaatactgatatgagtccttggaattgtaggactgattatcccatgagtctgcacattagatttccaaagaaccntgtgatagaggcaccaatgacaatacaactttgtttccaagaaccttgtaacaaagcgttgtctcttttaaacataccacttgaggcaaaaggaatcctggacaggagttttctgnagaggcgtttaaaaccctaccgaatccgcttctgctgccgtgctctgtaaatgtcatgaacaggggggacaacggctcccttttcttcatcttcatctgaatcctcgttgggccttttgacggccttgtctctccagagctgttcaatgttgatcatcggattaacacaacctcgttgataaactcttcggacagctgttattctttgattttctgcataagatcctacagcttccctgagattggataagaaatgccatcaattatattataaccaaatctcattcaacccagcaatctcactactggatatctacccaaagaacaactctatggaaaatagtatggagatttctcaaagaactaaaaattatattttagctaaancaactgtagatgtaaaaaaaaactatacaaatacttacacgccttttaggaaattgatgtaatccacccaaatctaagaaataaaatgaaatgttaatatct

SEQ ID NO: 361548 - DNA, 1228 bp, Homo sapiens
ggaccgcccgccgcgtggcgagggatgcggcctcggaggggcagaggctgaaccgcccctgcctgccgcgcatccctccggcttccgccgcggcgccagcccgcgcctgattcgcggcgggagcggcaggagggagaacgccgactccgtggcaggtgagagcgggagctggggcggaggctggcggggcccgtccgggaggcgcgcggtccaagtcgcacgcatctcttcgcctcttcccgtcggatcccatcccgggatgtcgggggcaggcgaggaagaggcggggtccgcgggcgggtggagctcacccctcgaggctgtcctctcggcgcgcccgcgtcctcccctactcccggccctgccactccctcgctggcctgaacagctgtttacaacggaatccggacgccgggcgcgagtggagctcagtgccagaggaggggattcccggcgccgggggacagagcccctttttttcttttgccgaaagaccctttctgctggggagcctcttgtgtccagcctaggcccgcgtgcagcgccgacggatgatcgtcttcttggcaagtgcgaggatcctcctcccctcggctctctttttagacacagtgggggttgaatggatgcgtgcgatataagcaaattaaatggttcgtggccgcatcctagagccctttaattagagttaccatttgtagaaggcctgccgtgcacaatccctcgtttcatctccccccaaaccgagcaggtaggtagctgtattttacagaggaggacactgaagttacacagctagtaaagagccagaactggggcccaggtatgtctgaaaccaacgcccagcctcccagatacagtgacatcacagagatgacgtagggattcatctctatcaacagatacttgtgggtgtctatttgggggatatacagatggagcataagtggggaatatgactggtcctggctcttaagaagttcgaaatctaggtggggaattttccacttccttttctcattttcttgtgccttggcttctgccctctgagtgaaatgccctccttttcacctcctctccccctccagacatgttttaactaggtgaaatcctactccttttaaagatcagttcaaatgtcatcttttctgggaaggttttctcaatctcctcccaggcagagttagtttcttcctctgctatattccctgggcaatttcataatgcc

SEQ ID NO: 361549 - DNA, 463 bp, Homo sapiens
atcactttagaaaccccatctgttgtcttggtgctggatatttcccatgtctgatcctcaataacacaattcactaaaggccaagcttggctcaatctgattttcccattcttactacttcacagccatgaatgtgattgctcaatccagttggccctgagagcaccttgccctgctgaccttcactgtcacctcggtcttgaatcagagccccaacccaaacactccctgcctgtccctaccccagcctttattctcaccacttgtttaacggcatgaccttttagtttctccattcccagacacccacacacccagacttccttctgagttgcaggtttctccttagatgtccaactagaaatattactaggaaagttacttttcaaagcaggaatgtgctgggaagtaggagacagcaactccctcctctctccccaaaattattggatcaaaaaagaaa

SEQ ID NO: 361550 - DNA, 205 bp, Homo sapiens
cattgttctggtttctgctatgatgaagtccttatttaagcttccttcaatcttgggaattgtattgactgtattgtgtgaattgtatactcactgcattgtgtggcttagatacaacatggttctggtaccatgaaggattctggtaccatgaaagtttgttggggttactaaactgtgtgactcttagggaacagtatgaagg

SEQ ID NO: 361551 - DNA, 2115 bp, Homo sapiens
agcttccgcaagctgcgcagcgccgggcctgagggcgtgtatccgcggccgtagcagccgggctggtcctgctgcgagccggcggcccggagtggggcggcggagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctctgataatgtgaaatgagaagtatttacattggagggccaatggctggtccttcaagtgctgttttgaagtgcagatttccattaaatgatgcctctgtttaatacacctggtacatttctgaagaggggctttataagcaggctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttattaccgtacatatttctcttgttttatgtaagtggatgtatatcctcttgttttatacaagccagttcccacttatgagggtacttttttggttttgctggcttaatattgtgtattggtcaatgaggccatttttacatttattacgttacagagttcatggaggttcacctttgtgactgattggtgataaaagatagccaagtgtcttacaagcagcctctgagtcaagtgttctaattttggaacaaagcaggttttactgcttttccagacacaaggctgctaaaccaattaagaaaataattaatttctttcaagcaactaaaaaatatatggtaatttaaaggtgtctgcttatttggttgaacaatttaattgggaaagtttgtcatcatttgaaaaaggaaatataaaaggaacaaccatatagccaacctgtggtctggcagaaacaacgtctctagcaatagtaccaaagtaagtaatggagtcttttttttggcaggtctgcagtaaaagataacattttcttttcttagtcctcctgctctcaacccccatattttgcctttgaatacgtgggttttagtatatatagcccaaaatggtaactgtctccagaacagcaaccacattgaattcttgtgacttaggaaagcttcttatagttgctgacattaattgcaagaaataactatatactactttgagaagtaaacatgtcaaaaaaaacaaagttcagatatgggacaaaatttaaaaattcagtaacatttataaacagaattgaatgaaaagagttacagaccaacttaaacatcaattcgtgtcagtaaactgacttttgggggtaatgatcattgttttgtatctcaaaagtattgagtttagaaatcagttgtatgatactacctttgtatgtctgtcttttcccgtgtatttttaaataactggtgatctataatttaataaaatttttcgttggtgtaatattatttcaaaagccctccaaatttagtcatcaaaattaaaatgacatttttcaagtttatttttaagcaactgaattcgtaaaattaaagtaacaaaaag

SEQ ID NO: 361552 - DNA, 2226 bp, Homo sapiens
agcttccgcaagctgcgcagcgccgggcctgagggcgtgtatccgcggccgtagcagccgggctggtcctgctgcgagccggcggcccggagtggggcggcgggcatgtaccttccacattgagtattcagaaagaagtgatctgaactctgaccattctttatggatacattaagtcaaatataagagtctgactacttgacacactggctcgagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctctgataatgtgaaatgagaagtatttacattggagggccaatggctggtccttcaagtgctgttttgaagtgcagatttccattaaatgatgcctctgtttaatacacctggtacatttctgaagaggggctttataagcaggctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttattaccgtacatatttctcttgttttatgtaagtggatgtatatcctcttgttttatacaagccagttcccacttatgagggtacttttttggttttgctggcttaatattgtgtattggtcaatgaggccatttttacatttattacgttacagagttcatggaggttcacctttgtgactgattggtgataaaagatagccaagtgtcttacaagcagcctctgagtcaagtgttctaattttggaacaaagcaggttttactgcttttccagacacaaggctgctaaaccaattaagaaaataattaatttctttcaagcaactaaaaaatatatggtaatttaaaggtgtctgcttatttggttgaacaatttaattgggaaagtttgtcatcatttgaaaaaggaaatataaaaggaacaaccatatagccaacctgtggtctggcagaaacaacgtctctagcaatagtaccaaagtaagtaatggagtcttttttttggcaggtctgcagtaaaagataacattttcttttcttagtcctcctgctctcaacccccatattttgcctttgaatacgtgggttttagtatatatagcccaaaatggtaactgtctccagaacagcaaccacattgaattcttgtgacttaggaaagcttcttatagttgctgacattaattgcaagaaataactatatactactttgagaagtaaacatgtcaaaaaaaacaaagttcagatatgggacaaaatttaaaaattcagtaacatttataaacagaattgaatgaaaagagttacagaccaacttaaacatcaattcgtgtcagtaaactgacttttgggggtaatgatcattgttttgtatctcaaaagtattgagtttagaaatcagttgtatgatactacctttgtatgtctgtcttttcccgtgtatttttaaataactggtgatctataatttaataaaatttttcgttggtgtaatattatttcaaaagccctccaaatttagtcatcaaaattaaaatgacatttttcaagtttatttttaagcaactgaattcgtaaaattaaagtaacaaaaag

SEQ ID NO: 361553 - DNA, 1136 bp, Homo sapiens
tgctttaaataaccacagctgacttacttgtatagagaggattaccgtacatatttctcttgttttatgtaagtggatgtatatcctcttgttttatacaagccagttcccacttatgagggtacttttttggttttgctggcttaatattgtgtattggtcaatgaggccatttttacatttattacgttacagagttcatggaggttcacctttgtgactgattggtgataaaagatagccaagtgtcttacaagcagcctctgagtcaagtgttctaattttggaacaaagcaggttttactgcttttccagacacaaggctgctaaaccaattaagaaaataattaatttctttcaagcaactaaaaaatatatggtaatttaaaggtgtctgcttatttggttgaacaatttaattgggaaagtttgtcatcatttgaaaaaggaaatataaaaggaacaaccatatagccaacctgtggtctggcagaaacaacgtctctagcaatagtaccaaagtaagtaatggagtcttttttttggcaggtctgcagtaaaagataacattttcttttcttagtcctcctgctctcaacccccatattttgcctttgaatacgtgggttttagtatatatagcccaaaatggtaactgtctccagaacagcaaccacattgaattcttgtgacttaggaaagcttcttatagttgctgacattaattgcaagaaataactatatactactttgagaagtaaacatgtcaaaaaaaacaaagttcagatatgggacaaaatttaaaaattcagtaacatttataaacagaattgaatgaaaagagttacagaccaacttaaacatcaattcgtgtcagtaaactgacttttgggggtaatgatcattgttttgtatctcaaaagtattgagtttagaaatcagttgtatgatactacctttgtatgtctgtcttttcccgtgtatttttaaataactggtgatctataatttaataaaatttttcgttggtgtaatattatttcaaaagccctccaaatttagtcatcaaaattaaaatgacatttttcaagtttatttttaagcaactgaattcgtaaaattaaagtaacaaaaag

SEQ ID NO: 361554 - DNA, 3781 bp, Homo sapiens
agcttccgcaagctgcgcagcgccgggcctgagggcgtgtatccgcggccgtagcagccgggctggtcctgctgcgagccggcggcccggagtggggcggcgggtaagtgggcacgaacgcggtggacgctgtacagtcgccttcgtcggtagggaactgctggcggcctaggggtcgtcctgagagggaaaagcgggctccggctgcatctgcggcgccctgcgtggccgtaagagccaagtggcctcagaggctcgccccctacgcaaatcctcgttgtcttgccagggtcctgacgtgacgtgcggccgcgagaaggaaggggcgggttgggggaggcgctgaggtggtagcagcggcggcttttgctgagttttctctggcccagagcgctcgggctgtcggtctagcaggggggactcccctgaggggccgctgcgggtcgccgtcttcggaggcaccggcgagggcagagccaacagcctcttcacggtctgtaaggtcattgtttgccagtcgtgggcagcgcggcaaacctgctgggaaaaggttttctggttggaataggatgagtaccgcaccagctttgccttccagctgagatgtaaatttcaggcctccatcctgtggaacgtgggaaaactatcttgagtgttggcatgttctaagtatgacataatagtttaatgtatgataaatcatgggtgtttagacgaaagatttacacatataaattggaggctttagcggtcttagtgtaactaacttttcgtccccttaacccttgatgcctgttctatgggtctctagagcggaaggagcattatactccggaaacatttgctggaaggggttatgagaaattcctctctgtatgctaactccgtaatacaagcgtttgtgtattttaaaatcacagctgttccaaatataatctagcctcgttttccccctccgtcggatgataggtgttcttcaggacagttttattttaagcaattcttagtctcaagtaaacaccatcattaaaagaactgagaactattatcaattcttcctttggagtccatcttcaatggaaaggagaagggaaaaccttttttaaaaagaagaaagaaaactgaagtttttgatttgactagagaaatattcagaagactccttattttcacctagtctaatcacaaaattgagaaacaaacattatcccttgaccatgtaaattttacaccacattatgtcaacagcatgtaccttccacattgagtattcagaaagaagtgatctgaactctgaccattctttatggatacattaagtcaaatataagagtctgactacttgacacactggctcggtgagttctgctttttctttttaatataaatttattatgttggtaaatttagcttttggcttttcactttgctctcatgatataagaaaatgtaggttttctctttcagtttgaattttcctattcagtaaaacaacatgctagaaaacaaacttttggaaaggcattgtaactattttttcaaatagaaccataataacaagtcttgtcttaccctaaagtcaaatgctgaagattctttactgctgtcatcagcatctacaagtagcatattttggatggtgtttgtgtgctacttcaaagtaactaggaaaaaataatcctcgcaacacaggtaccttgtcatgtcagaattgggggtgttaggttgccagttgtatcagtgttgattcatttcattacttcctacagagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctctgataatgtgaaatgagaagtatttacattggagggccaatggctggtccttcaagtgctgttttgaagtgcagatttccattaaatgatgcctctgtttaatacacctggtacatttctgaagaggggctttataagcaggctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttattaccgtacatatttctcttgttttatgtaagtggatgtatatcctcttgttttatacaagccagttcccacttatgagggtacttttttggttttgctggcttaatattgtgtattggtcaatgaggccatttttacatttattacgttacagagttcatggaggttcacctttgtgactgattggtgataaaagatagccaagtgtcttacaagcagcctctgagtcaagtgttctaattttggaacaaagcaggttttactgcttttccagacacaaggctgctaaaccaattaagaaaataattaatttctttcaagcaactaaaaaatatatggtaatttaaaggtgtctgcttatttggttgaacaatttaattgggaaagtttgtcatcatttgaaaaaggaaatataaaaggaacaaccatatagccaacctgtggtctggcagaaacaacgtctctagcaatagtaccaaagtaagtaatggagtcttttttttggcaggtctgcagtaaaagataacattttcttttcttagtcctcctgctctcaacccccatattttgcctttgaatacgtgggttttagtatatatagcccaaaatggtaactgtctccagaacagcaaccacattgaattcttgtgacttaggaaagcttcttatagttgctgacattaattgcaagaaataactatatactactttgagaagtaaacatgtcaaaaaaaacaaagttcagatatgggacaaaatttaaaaattcagtaacatttataaacagaattgaatgaaaagagttacagaccaacttaaacatcaattcgtgtcagtaaactgacttttgggggtaatgatcattgttttgtatctcaaaagtattgagtttagaaatcagttgtatgatactacctttgtatgtctgtcttttcccgtgtatttttaaataactggtgatctataatttaataaaatttttcgttggtgtaatattatttcaaaagccctccaaatttagtcatcaaaattaaaatgacatttttcaagtttatttttaagcaactgaattcgtaaaattaaagtaacaaaaag

SEQ ID NO: 361555 - DNA, 3370 bp, Homo sapiens
agcttccgcaagctgcgcagcgccgggcctgagggcgtgtatccgcggccgtagcagccgggctggtcctgctgcgagccggcggcccggagtggggcggcgggtaagtgggcacgaacgcggtggacgctgtacagtcgccttcgtcggtagggaactgctggcggcctaggggtcgtcctgagagggaaaagcgggctccggctgcatctgcggcgccctgcgtggccgtaagagccaagtggcctcagaggctcgccccctacgcaaatcctcgttgtcttgccagggtcctgacgtgacgtgcggccgcgagaaggaaggggcgggttgggggaggcgctgaggtggtagcagcggcggcttttgctgagttttctctggcccagagcgctcgggctgtcggtctagcaggggggactcccctgaggggccgctgcgggtcgccgtcttcggaggcaccggcgagggcagagccaacagcctcttcacggtctgtaaggtcattgtttgccagtcgtgggcagcgcggcaaacctgctgggaaaaggttttctggttggaataggatgagtaccgcaccagctttgccttccagctgagatgtaaatttcaggcctccatcctgtggaacgtgggaaaactatcttgagtgttggcatgttctaagtatgacataatagtttaatgtatgataaatcatgggtgtttagacgaaagatttacacatataaattggaggctttagcggtcttagtgtaactaacttttcgtccccttaacccttgatgcctgttctatgggtctctagagcggaaggagcattatactccggaaacatttgctggaaggggttatgagaaattcctctctgtatgctaactccgtaatacaagcgtttgtgtattttaaaatcacagctgttccaaatataatctagcctcgttttccccctccgtcggatgataggtgttcttcaggacagttttattttaagcaattcttagtctcaagtaaacaccatcattaaaagaactgagaactattatcaattcttcctttggagtccatcttcaatggaaaggagaagggaaaaccttttttaaaaagaagaaagaaaactgaagtttttgatttgactagagaaatattcagaagactccttattttcacctagtctaatcacaaaattgagaaacaaacattatcccttgaccatgtaaattttacaccacattatgtcaacagcatgtaccttccacattgagtattcagaaagaagtgatctgaactctgaccattctttatggatacattaagtcaaatataagagtctgactacttgacacactggctcgagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctctgataatgtgaaatgagaagtatttacattggagggccaatggctggtccttcaagtgctgttttgaagtgcagatttccattaaatgatgcctctgtttaatacacctggtacatttctgaagaggggctttataagcaggctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttattaccgtacatatttctcttgttttatgtaagtggatgtatatcctcttgttttatacaagccagttcccacttatgagggtacttttttggttttgctggcttaatattgtgtattggtcaatgaggccatttttacatttattacgttacagagttcatggaggttcacctttgtgactgattggtgataaaagatagccaagtgtcttacaagcagcctctgagtcaagtgttctaattttggaacaaagcaggttttactgcttttccagacacaaggctgctaaaccaattaagaaaataattaatttctttcaagcaactaaaaaatatatggtaatttaaaggtgtctgcttatttggttgaacaatttaattgggaaagtttgtcatcatttgaaaaaggaaatataaaaggaacaaccatatagccaacctgtggtctggcagaaacaacgtctctagcaatagtaccaaagtaagtaatggagtcttttttttggcaggtctgcagtaaaagataacattttcttttcttagtcctcctgctctcaacccccatattttgcctttgaatacgtgggttttagtatatatagcccaaaatggtaactgtctccagaacagcaaccacattgaattcttgtgacttaggaaagcttcttatagttgctgacattaattgcaagaaataactatatactactttgagaagtaaacatgtcaaaaaaaacaaagttcagatatgggacaaaatttaaaaattcagtaacatttataaacagaattgaatgaaaagagttacagaccaacttaaacatcaattcgtgtcagtaaactgacttttgggggtaatgatcattgttttgtatctcaaaagtattgagtttagaaatcagttgtatgatactacctttgtatgtctgtcttttcccgtgtatttttaaataactggtgatctataatttaataaaatttttcgttggtgtaatattatttcaaaagccctccaaatttagtcatcaaaattaaaatgacatttttcaagtttatttttaagcaactgaattcgtaaaattaaagtaacaaaaag

SEQ ID NO: 361556 - DNA, 2616 bp, Homo sapiens
agcttccgcaagctgcgcagcgccgggcctgagggcgtgtatccgcggccgtagcagccgggctggtcctgctgcgagccggcggcccggagtggggcggcgggtaagtgggcacgaacgcggtggacgctgtacagtcgccttcgtcggtagggaactgctggcggcctaggggtcgtcctgagagggaaaagcgggctccggctgcatctgcggcgccctgcgtggccgtaagagccaagtggcctcagaggctcgccccctacgcaaatcctcgttgtcttgccagggtcctgacgtgacgtgcggccgcgagaaggaaggggcgggttgggggaggcgctgaggtggtagcagcggcggcttttgctgagttttctctggcccagagcgctcgggctgtcggtctagcaggggggactcccctgaggggccgctgcgggtcgccgtcttcggaggcaccggcgagggcagagccaacagcctcttcacggcatgtaccttccacattgagtattcagaaagaagtgatctgaactctgaccattctttatggatacattaagtcaaatataagagtctgactacttgacacactggctcgagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctctgataatgtgaaatgagaagtatttacattggagggccaatggctggtccttcaagtgctgttttgaagtgcagatttccattaaatgatgcctctgtttaatacacctggtacatttctgaagaggggctttataagcaggctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttattaccgtacatatttctcttgttttatgtaagtggatgtatatcctcttgttttatacaagccagttcccacttatgagggtacttttttggttttgctggcttaatattgtgtattggtcaatgaggccatttttacatttattacgttacagagttcatggaggttcacctttgtgactgattggtgataaaagatagccaagtgtcttacaagcagcctctgagtcaagtgttctaattttggaacaaagcaggttttactgcttttccagacacaaggctgctaaaccaattaagaaaataattaatttctttcaagcaactaaaaaatatatggtaatttaaaggtgtctgcttatttggttgaacaatttaattgggaaagtttgtcatcatttgaaaaaggaaatataaaaggaacaaccatatagccaacctgtggtctggcagaaacaacgtctctagcaatagtaccaaagtaagtaatggagtcttttttttggcaggtctgcagtaaaagataacattttcttttcttagtcctcctgctctcaacccccatattttgcctttgaatacgtgggttttagtatatatagcccaaaatggtaactgtctccagaacagcaaccacattgaattcttgtgacttaggaaagcttcttatagttgctgacattaattgcaagaaataactatatactactttgagaagtaaacatgtcaaaaaaaacaaagttcagatatgggacaaaatttaaaaattcagtaacatttataaacagaattgaatgaaaagagttacagaccaacttaaacatcaattcgtgtcagtaaactgacttttgggggtaatgatcattgttttgtatctcaaaagtattgagtttagaaatcagttgtatgatactacctttgtatgtctgtcttttcccgtgtatttttaaataactggtgatctataatttaataaaatttttcgttggtgtaatattatttcaaaagccctccaaatttagtcatcaaaattaaaatgacatttttcaagtttatttttaagcaactgaattcgtaaaattaaagtaacaaaaag

SEQ ID NO: 361557 - DNA, 3169 bp, Homo sapiens
agcttccgcaagctgcgcagcgccgggcctgagggcgtgtatccgcggccgtagcagccgggctggtcctgctgcgagccggcggcccggagtggggcggcgggtaagtgggcacgaacgcggtggacgctgtacagtcgccttcgtcggtagggaactgctggcggcctaggggtcgtcctgagagggaaaagcgggctccggctgcatctgcggcgccctgcgtggccgtaagagccaagtggcctcagaggctcgccccctacgcaaatcctcgttgtcttgccagggtcctgacgtgacgtgcggccgcgagaaggaaggggcgggttgggggaggcgctgaggtggtagcagcggcggcttttgctgagttttctctggcccagagcgctcgggctgtcggtctagcaggggggactcccctgaggggccgctgcgggtcgccgtcttcggaggcaccggcgagggcagagccaacagcctcttcacggtctgtaaggtcattgtttgccagtcgtgggcagcgcggcaaacctgctgggaaaaggttttctggttggaataggatgagtaccgcaccagctttgccttccagctgagatgtaaatttcaggcctccatcctgtggaacgtgggaaaactatcttgagtgttggcatgttctaagtatgacataatagtttaatgtatgataaatcatgggtgtttagacgaaagatttacacatataaattggaggctttagcggtcttagtgtaactaacttttcgtccccttaacccttgatgcctgttctatgggtctctagagcggaaggagcattatactccggaaacatttgctggaaggggttatgagaaattcctctctgtatgctaactccgtaatacaagcgtttgtgtattttaaaatcacagctgttccaaatataatctagcctcgttttccccctccgtcggatgataggtgttcttcaggacagttttattttaagcaattcttagtctcaagtaaacaccatcattaaaagaactgagaactattatcaattcttcctttggagtccatcttcaatggaaaggagaagggaaaaccttttttaaaaagaagaaagaaaactgaagtttttgatttgactagagaaatattcagaagactccttattttcacctagtctaatcacaaaattgagaaacaaacattatcccttgaccatgtaaattttacaccacattatgtcaacagcatgtaccttccacattgagtattcagaaagaagtgatctgaactctgaccattctttatggatacattaagtcaaatataagagtctgactacttgacacactggctcggtgagttctgctttttctttttaatataaatttattatgttggtaaatttagcttttggcttttcactttgctctcatgatataagaaaatgtaggttttctctttcagtttgaattttcctattcagtaaaacaacatgctagaaaacaaacttttggaaaggcattgtaactattttttcaaatagaaccataataacaagtcttgtcttaccctaaagtcaaatgctgaagattctttactgctgtcatcagcatctacaagtagcatattttggatggtgtttgtgtgctacttcaaagtaactaggaaaaaataatcctcgcaacacaggtaccttgtcatgtcagaattgggggtgttaggttgccagttgtatcagtgttgattcatttcattacttcctacagagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctctgataatgtgaaatgagaagtatttacattggagggccaatggctggtccttcaagtgctgttttgaagtgcagatttccattaaatgatgcctctgtttaatacacctggtacatttctgaagaggggctttataagcaggctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaagaaaaaacaacaaaaaacaaaaaaaacaaagacgaaagaaaccacgaacggaggagaacaaagagagaaaggaaggagaaagaataaaaaaagaaaaaagataggggagaggaggtaagaagagaagaggagagagtcagatagagaaggaagaggagaagtaacagaaagcaaaggatgagtgaggactataaagacaagcaaagaaggagaggagaacgaagacagacgagaacagcgaacgcagcaacggacgggagcggaggaagagaggcaaaagagatgagacggaacacaagcagaggagaggagggaccagagcgaaggaggaggagaggagcagaacacggagaagagggagagaggcaaaaaagacacagggggggg

SEQ ID NO: 361558 - DNA, 2024 bp, Homo sapiens
ctttttcagaaacatacatggaaatacagaactacacctgtaattacagagggcatatgaaccctagtttgataagccttgctttaaaggatgcagtgtgttctattaaatgtatttaatacaattgcagaaatggaaaatgtggacctccattaaacaaattttttagttcctaatgagataaacttgggaccaaaccgattcctcttgttttagtgctcaaaaatagtttcatttttaggtatttatgctttagtggcctttttttctacctttaaaattgtttaagttccaagtaattttatttttggatgttatatatattcttaacttttatctctacagatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctctgataatgtgaaatgagaagtatttacattggagggccaatggctggtccttcaagtgctgttttgaagtgcagatttccattaaatgatgcctctgtttaatacacctggtacatttctgaagaggggctttataagcaggctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttattaccgtacatatttctcttgttttatgtaagtggatgtatatcctcttgttttatacaagccagttcccacttatgagggtacttttttggttttgctggcttaatattgtgtattggtcaatgaggccatttttacatttattacgttacagagttcatggaggttcacctttgtgactgattggtgataaaagatagccaagtgtcttacaagcagcctctgagtcaagtgttctaattttggaacaaagcaggttttactgcttttccagacacaaggctgctaaaccaattaagaaaataattaatttctttcaagcaactaaaaaatatatggtaatttaaaggtgtctgcttatttggttgaacaatttaattgggaaagtttgtcatcatttgaaaaaggaaatataaaaggaacaaccatatagccaacctgtggtctggcagaaacaacgtctctagcaatagtaccaaagtaagtaatggagtcttttttttggcaggtctgcagtaaaagataacattttcttttcttagtcctcctgctctcaacccccatattttgcctttgaatacgtgggttttagtatatatagcccaaaatggtaactgtctccagaacagcaaccacattgaattcttgtgacttaggaaagcttcttatagttgctgacattaattgcaagaaataactatatactactttgagaagtaaacatgtcaaaaaaaacaaagttcagatatgggacaaaatttaaaaattcagtaacatttataaacagaattgaatgaaaagagttacagaccaacttaaacatcaattcgtgtcagtaaactgacttttgggggtaatgatcattgttttgtatctcaaaagtattgagtttagaaatcagttgtatgatactacctttgtatgtctgtcttttcccgtgtatttttaaataactggtgatctataatttaataaaatttttcgttggtgtaatattatttcaaaagccctccaaatttagtcatcaaaattaaaatgacatttttcaagtttatttttaagcaactgaattcgtaaaattaaagtaacaaaaag

SEQ ID NO: 361559 - DNA, 2128 bp, Homo sapiens
agcttccgcaagctgcgcagcgccgggcctgagggcgtgtatccgcggccgtagcagccgggctggtcctgctgcgagccggcggcccggagtggggcggcgggtaagtgggcacgaacgcggtggacgctgtacagtcgccttcgtcggtagggaactgctggcggcctaggggtcgtcctgagagggaaaagcgggctccggctgcatctgcggcgccctgcgtggccgtaagagccaagtggcctcagaggctcgccccctacgcaaatcctcgttgtcttgccagggtcctgacgtgacgtgcggccgcgagaaggaaggggcgggttgggggaggcgctgaggtggtagcagcggcggcttttgctgagttttctctggcccagagcgctcgggctgtcggtctagcaggggggactcccctgaggggccgctgcgggtcgccgtcttcggaggcaccggcgagggcagagccaacagcctcttcacggtctgtaaggtcattgtttgccagtcgtgggcagcgcggcaaacctgctgggaaaaggttttctggttggaataggatgagtaccgcaccagctttgccttccagctgagatgtaaatttcaggcctccatcctgtggaacgtgggaaaactatcttgagtgttggcatgttctaagtatgacataatagtttaatgtatgataaatcatgggtgtttagacgaaagatttacacatataaattggaggctttagcggtcttagtgtaactaacttttcgtccccttaacccttgatgcctgttctatgggtctctagagcggaaggagcattatactccggaaacatttgctggaaggggttatgagaaattcctctctgtatgctaactccgtaatacaagcgtttgtgtattttaaaatcacagctgttccaaatataatctagcctcgttttccccctccgtcggatgataggtgttcttcaggacagttttattttaagcaattcttagtctcaagtaaacaccatcattaaaagaactgagaactattatcaattcttcctttggagtccatcttcaatggaaaggagaagggaaaaccttttttaaaaagaagaaagaaaactgaagtttttgatttgactagagaaatattcagaagactccttattttcacctagtctaatcacaaaattgagaaacaaacattatcccttgaccatgtaaattttacaccacattatgtcaacagcatgtaccttccacattgagtattcagaaagaagtgatctgaactctgaccattctttatggatacattaagtcaaatataagagtctgactacttgacacactggctcggtgagttctgctttttctttttaatataaatttattatgttggtaaatttagcttttggcttttcactttgctctcatgatataagaaaatgtaggttttctctttcagtttgaattttcctattcagtaaaacaacatgctagaaaacaaacttttggaaaggcattgtaactattttttcaaatagaaccataataacaagtcttgtcttaccctaaagtcaaatgctgaagattctttactgctgtcatcagcatctacaagtagcatattttggatggtgtttgtgtgctacttcaaagtaactaggaaaaaataatcctcgcaacacaggtaccttgtcatgtcagaattgggggtgttaggttgccagttgtatcagtgttgattcatttcattacttcctacagagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctgtaagtggcagaaatttttaggtatg

SEQ ID NO: 361560 - DNA, 1875 bp, Homo sapiens
agcttccgcaagctgcgcagcgccgggcctgagggcgtgtatccgcggccgtagcagccgggctggtcctgctgcgagccggcggcccggagtggggcggcgggtaagtgggcacgaacgcggtggacgctgtacagtcgccttcgtcggtagggaactgctggcggcctaggggtcgtcctgagagggaaaagcgggctccggctgcatctgcggcgccctgcgtggccgtaagagccaagtggcctcagaggctcgccccctacgcaaatcctcgttgtcttgccagggtcctgacgtgacgtgcggccgcgagaaggaaggggcgggttgggggaggcgctgaggtggtagcagcggcggcttttgctgagttttctctggcccagagcgctcgggctgtcggtctagcaggggggactcccctgaggggccgctgcgggtcgccgtcttcggaggcaccggcgagggcagagccaacagcctcttcacggtctgtaaggtcattgtttgccagtcgtgggcagcgcggcaaacctgctgggaaaaggttttctggttggaataggatgagtaccgcaccagctttgccttccagctgagatgtaaatttcaggcctccatcctgtggaacgtgggaaaactatcttgagtgttggcatgttctaagtatgacataatagtttaatgtatgataaatcatgggtgtttagacgaaagatttacacatataaattggaggctttagcggtcttagtgtaactaacttttcgtccccttaacccttgatgcctgttctatgggtctctagagcggaaggagcattatactccggaaacatttgctggaaggggttatgagaaattcctctctgtatgctaactccgtaatacaagcgtttgtgtattttaaaatcacagctgttccaaatataatctagcctcgttttccccctccgtcggatgataggtgttcttcaggacagttttattttaagcaattcttagtctcaagtaaacaccatcattaaaagaactgagaactattatcaattcttcctttggagtccatcttcaatggaaaggagaagggaaaaccttttttaaaaagaagaaagaaaactgaagtttttgatttgactagagaaatattcagaagactccttattttcacctagtctaatcacaaaattgagaaacaaacattatcccttgaccatgtaaattttacaccacattatgtcaacagcatgtaccttccacattgagtattcagaaagaagtgatctgaactctgaccattctttatggatacattaagtcaaatataagagtctgactacttgacacactggctcggtgagttctgctttttctttttaatataaatttattatgttggtaaatttagcttttggcttttcactttgctctcatgatataagaaaatgtaggttttctctttcagtttgaattttcctattcagtaaaacaacatgctagaaaacaaacttttggaaaggcattgtaactattttttcaaatagaaccataataacaagtcttgtcttaccctaaagtcaaatgctgaagattctttactgctgtcatcagcatctacaagtagcatattttggatggtgtttgtgtgctacttcaaagtaactaggaagttgccagttgtatcagtgttgattcatttcattacttcctacagagcaaacatgaacgttggagttgcccacagtgaagtgaatccaaatacccgtgtcatgaacagccggggtatgtggctgacatatgcattgggagttggcttgcttcatatcccctaatcagacctcctccttaccgtcccgctctcgcatttataacg

SEQ ID NO: 361561 - DNA, 1886 bp, Homo sapiens
cacgcgtccgcggacgcgtggggcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctctgataatgtgaaatgagaagtatttacattggagggccaatggctggtccttcaagtgctgttttgaagtgcagatttccattaaatgatgcctctgtttaatacacctggtacatttctgaagaggggctttataagcaggctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttattaccgtacatatttctcttgttttatgtaagtggatgtatatcctcttgttttatacaagccagttcccacttatgagggtacttttttggttttgctggcttaatattgtgtattggtcaatgaggccatttttacatttattacgttacagagttcatggaggttcacctttgtgactgattggtgataaaagatagccaagtgtcttacaagcagcctctgagtcaagtgttctaattttggaacaaagcaggttttactgcttttccagacacaaggctgctaaaccaattaagaaaataattaatttctttcaagcaactaaaaaatatatggtaatttaaaggtgtctgcttatttggttgaacaatttaattgggaaagtttgtcatcatttgaaaaaggaaatataaaaggaacaaccatatagccaacctgtggtctggcagaaacaacgtctctagcaatagtaccaaagtaagtaatggagtcttttttttggcaggtctgcagtaaaagataacattttcttttcttagtcctcctgctctcaacccccatattttgcctttgaatacgtgggttttagtatatatagcccaaaatggtaactgtctccagaacagcaaccacattgaattcttgtgacttaggaaagcttcttatagttgctgacattaattgcaagaaataactatatactactttgagaagtaaacatgtcaaaaaaaacaaagttcagatatgggacaaaatttaaaaattcagtaacatttataaacagaattgaatgaaaagagttacagaccaacttaaacatcaattcgtgtcagtaaactgacttttgggggtaatgatcattgttttgtatctcaaaagtattgagtttagaaatcagttgtatgatactacctttgtatgtctgtcttttcccgtgtatttttaaataactggtgatctataatttaataaaatttttcgttggtgtaatattatttcaaaagccctccaaatttagtcatcaaaattaaaatgacatttttcaagtttatttttaagcaactgaattcgtaaaattaaagtaacaaaaag

SEQ ID NO: 361562 - DNA, 3728 bp, Homo sapiens
agcttccgcaagctgcgcagcgccgggcctgagggcgtgtatccgcggccgtagcagccgggctggtcctgctgcgagccggcggcccggagtggggcggcgggtaagtgggcacgaacgcggtggacgctgtacagtcgccttcgtcggtagggaactgctggcggcctaggggtcgtcctgagagggaaaagcgggctccggctgcatctgcggcgccctgcgtggccgtaagagccaagtggcctcagaggctcgccccctacgcaaatcctcgttgtcttgccagggtcctgacgtgacgtgcggccgcgagaaggaaggggcgggttgggggaggcgctgaggtggtagcagcggcggcttttgctgagttttctctggcccagagcgctcgggctgtcggtctagcaggggggactcccctgaggggccgctgcgggtcgccgtcttcggaggcaccggcgagggcagagccaacagcctcttcacggtctgtaaggtcattgtttgccagtcgtgggcagcgcggcaaacctgctgggaaaaggttttctggttggaataggatgagtaccgcaccagctttgccttccagctgagatgtaaatttcaggcctccatcctgtggaacgtgggaaaactatcttgagtgttggcatgttctaagtatgacataatagtttaatgtatgataaatcatgggtgtttagacgaaagatttacacatataaattggaggctttagcggtcttagtgtaactaacttttcgtccccttaacccttgatgcctgttctatgggtctctagagcggaaggagcattatactccggaaacatttgctggaaggggttatgagaaattcctctctgtatgctaactccgtaatacaagcgtttgtgtattttaaaatcacagctgttccaaatataatctagcctcgttttccccctccgtcggatgataggtgttcttcaggacagttttattttaagcaattcttagtctcaagtaaacaccatcattaaaagaactgagaactattatcaattcttcctttggagtccatcttcaatggaaaggagaagggaaaaccttttttaaaaagaagaaagaaaactgaagtttttgatttgactagagaaatattcagaagactccttattttcacctagtctaatcacaaaattgagaaacaaacattatcccttgaccatgtaaattttacaccacattatgtcaacagcatgtaccttccacattgagtattcagaaagaagtgatctgaactctgaccattctttatggatacattaagtcaaatataagagtctgactacttgacacactggctcggtgagttctgctttttctttttaatataaatttattatgttggtaaatttagcttttggcttttcactttgctctcatgatataagaaaatgtaggttttctctttcagtttgaattttcctattcagtaaaacaacatgctagaaaacaaacttttggaaaggcattgtaactattttttcaaatagaaccataataacaagtcttgtcttaccctaaagtcaaatgctgaagattctttactgctgtcatcagcatctacaagtagcatattttggatggtgtttgtgtgctacttcaaagtaactaggaagttgccagttgtatcagtgttgattcatttcattacttcctacagagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctctgataatgtgaaatgagaagtatttacattggagggccaatggctggtccttcaagtgctgttttgaagtgcagatttccattaaatgatgcctctgtttaatacacctggtacatttctgaagaggggctttataagcaggctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttattaccgtacatatttctcttgttttatgtaagtggatgtatatcctcttgttttatacaagccagttcccacttatgagggtacttttttggttttgctggcttaatattgtgtattggtcaatgaggccatttttacatttattacgttacagagttcatggaggttcacctttgtgactgattggtgataaaagatagccaagtgtcttacaagcagcctctgagtcaagtgttctaattttggaacaaagcaggttttactgcttttccagacacaaggctgctaaaccaattaagaaaataattaatttctttcaagcaactaaaaaatatatggtaatttaaaggtgtctgcttatttggttgaacaatttaattgggaaagtttgtcatcatttgaaaaaggaaatataaaaggaacaaccatatagccaacctgtggtctggcagaaacaacgtctctagcaatagtaccaaagtaagtaatggagtcttttttttggcaggtctgcagtaaaagataacattttcttttcttagtcctcctgctctcaacccccatattttgcctttgaatacgtgggttttagtatatatagcccaaaatggtaactgtctccagaacagcaaccacattgaattcttgtgacttaggaaagcttcttatagttgctgacattaattgcaagaaataactatatactactttgagaagtaaacatgtcaaaaaaaacaaagttcagatatgggacaaaatttaaaaattcagtaacatttataaacagaattgaatgaaaagagttacagaccaacttaaacatcaattcgtgtcagtaaactgacttttgggggtaatgatcattgttttgtatctcaaaagtattgagtttagaaatcagttgtatgatactacctttgtatgtctgtcttttcccgtgtatttttaaataactggtgatctataatttaataaaatttttcgttggtgtaatattatttcaaaagccctccaaatttagtcatcaaaattaaaatgacatttttcaagtttatttttaagcaactgaattcgtaaaattaaagtaacaaaaag

SEQ ID NO: 361563 - DNA, 2894 bp, Homo sapiens
agcttccgcaagctgcgcagcgccgggcctgagggcgtgtatccgcggccgtagcagccgggctggtcctgctgcgagccggcggcccggagtggggcggcgggtaagtgggcacgaacgcggtggacgctgtacagtcgccttcgtcggtagggaactgctggcggcctaggggtcgtcctgagagggaaaagcgggctccggctgcatctgcggcgccctgcgtggccgtaagagccaagtggcctcagaggctcgccccctacgcaaatcctcgttgtcttgccagggtcctgacgtgacgtgcggccgcgagaaggaaggggcgggttgggggaggcgctgaggtggtagcagcggcggcttttgctgagttttctctggcccagagcgctcgggctgtcggtctagcaggggggactcccctgaggggccgctgcgggtcgccgtcttcggaggcaccggcgagggcagagccaacagcctcttcacggtgttcttcaggacagttttattttaagcaattcttagtctcaagtaaacaccatcattaaaagaactgagaactattatcaattcttcctttggagtccatcttcaatggaaaggagaagggaaaaccttttttaaaaagaagaaagaaaactgaagtttttgatttgactagagaaatattcagaagactccttattttcacctagtctaatcacaaaattgagaaacaaacattatcccttgaccatgtaaattttacaccacattatgtcaacagcatgtaccttccacattgagtattcagaaagaagtgatctgaactctgaccattctttatggatacattaagtcaaatataagagtctgactacttgacacactggctcgagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctctgataatgtgaaatgagaagtatttacattggagggccaatggctggtccttcaagtgctgttttgaagtgcagatttccattaaatgatgcctctgtttaatacacctggtacatttctgaagaggggctttataagcaggctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttattaccgtacatatttctcttgttttatgtaagtggatgtatatcctcttgttttatacaagccagttcccacttatgagggtacttttttggttttgctggcttaatattgtgtattggtcaatgaggccatttttacatttattacgttacagagttcatggaggttcacctttgtgactgattggtgataaaagatagccaagtgtcttacaagcagcctctgagtcaagtgttctaattttggaacaaagcaggttttactgcttttccagacacaaggctgctaaaccaattaagaaaataattaatttctttcaagcaactaaaaaatatatggtaatttaaaggtgtctgcttatttggttgaacaatttaattgggaaagtttgtcatcatttgaaaaaggaaatataaaaggaacaaccatatagccaacctgtggtctggcagaaacaacgtctctagcaatagtaccaaagtaagtaatggagtcttttttttggcaggtctgcagtaaaagataacattttcttttcttagtcctcctgctctcaacccccatattttgcctttgaatacgtgggttttagtatatatagcccaaaatggtaactgtctccagaacagcaaccacattgaattcttgtgacttaggaaagcttcttatagttgctgacattaattgcaagaaataactatatactactttgagaagtaaacatgtcaaaaaaaacaaagttcagatatgggacaaaatttaaaaattcagtaacatttataaacagaattgaatgaaaagagttacagaccaacttaaacatcaattcgtgtcagtaaactgacttttgggggtaatgatcattgttttgtatctcaaaagtattgagtttagaaatcagttgtatgatactacctttgtatgtctgtcttttcccgtgtatttttaaataactggtgatctataatttaataaaatttttcgttggtgtaatattatttcaaaagccctccaaatttagtcatcaaaattaaaatgacatttttcaagtttatttttaagcaactgaattcgtaaaattaaagtaacaaaaag

SEQ ID NO: 361564 - DNA, 2748 bp, Homo sapiens
agcttccgcaagctgcgcagcgccgggcctgagggcgtgtatccgcggccgtagcagccgggctggtcctgctgcgagccggcggcccggagtggggcggcgggtaagtgggcacgaacgcggtggacgctgtacagtcgccttcgtcggtagggaactgctggcggcctaggggtcgtcctgagagggaaaagcgggctccggctgcatctgcggcgccctgcgtggccgtaagagccaagtggcctcagaggctcgccccctacgcaaatcctcgttgtcttgccagggtcctgacgtgacgtgcggccgcgagaaggaaggggcgggttgggggaggcgctgaggtggtagcagcggcggcttttgctgagttttctctggcccagagcgctcgggctgtcggtctagcaggggggactcccctgaggggccgctgcgggtcgccgtcttcggaggcaccggcgagggcagagccaacagcctcttcacggtctgtaaggtcattgtttgccagtcgtgggcagcgcggcaaacctgctgggaaaaggttttctggttggaataggatgagtaccgcaccagctttgccttccagctgagatgtaaatttcaggcctccatcctgtggaacgtgggaaaactatcttgagtgttggcatgttctaagtatgacataatagtttaatgtatgataaatcatgggtgtttagacgaaagatttacacatataaattggaggctttagcggtcttagtgtaactaacttttcgtccccttaacccttgatgcctgttctatgggtctctagagcggaaggagcattatactccggaaacatttgctggaaggggttatgagaaattcctctctgtatgctaactccgtaatacaagcgtttgtgtattttaaaatcacagctgttccaaatataatctagcctcgttttccccctccgtcggatgataggtgttcttcaggacagttttattttaagcaattcttagtctcaagtaaacaccatcattaaaagaactgagaactattatcaattcttcctttggagtccatcttcaatggaaaggagaagggaaaaccttttttaaaaagaagaaagaaaactgaagtttttgatttgactagagaaatattcagaagactccttattttcacctagtctaatcacaaaattgagaaacaaacattatcccttgaccatgtaaattttacaccacattatgtcaacagcatgtaccttccacattgagtattcagaaagaagtgatctgaactctgaccattctttatggatacattaagtcaaatataagagtctgactacttgacacactggctcggtgagttctgctttttctttttaatataaatttattatgttggtaaatttagcttttggcttttcactttgctctcatgatataagaaaatgtaggttttctctttcagtttgaattttcctattcagtaaaacaacatgctagaaaacaaacttttggaaaggcattgtaactattttttcaaatagaaccataataacaagtcttgtcttaccctaaagtcaaatgctgaagattctttactgctgtcatcagcatctacaagtagcatattttggatggtgtttgtgtgctacttcaaagtaactaggaaaaaataatcctcgcaacacaggtaccttgtcatgtcagaattgggggtgttaggttgccagttgtatcagtgttgattcatttcattacttcctacagagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctctgataatgtgaaatgagaagtatttacattggagggccaatggctggtccttcaagtgctgttttgaagtgcagatttccattaaatgatgcctctgtttaatacacctggtacatttctgaagaggggctttataagcaggctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttcggtaataaaaataatctttaataaacttgtatagagaggattatttttattaccgtaaaaaa

SEQ ID NO: 361565 - DNA, 1374 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctggctgcgcctctcctgagctgccgcattctcccctgcacctgtgcgtctggccctcttcacgtcctcctggcctgctgtctgcctctcccctgcacctgtgcgtctgtccctcttcatgtcctccttgcctgctgtctgcctgttctcagagcccctcagccctcaggccttcatctctcctggcccatcttcctactctgacgctgacatgtagtaaaagtctgaagacagagaagagtgcatgtgcgtttagcataggaggggcagctttcagtcagtgcagcaagggcatgtagttgttcagagatggtgctggaacgactgatttggagaaaagaggcccttcttcacaccatctgctaaaataaacctcagatgggctcaagagttaaatatttaagaaaaggaggaaacaaaaaaattgctacaagtttatttgttgttaggatgggaaaggtttttctaagaaccaagttcataatgaagctgtcaaataaaatacttga

SEQ ID NO: 361566 - DNA, 4046 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaagtaagtgtccacagctgggactggcaccgtcttgtggggcctcctggtccacagtctgcaggtgggccaaggccctgggagatcccatacgacggttggataaatgagggtacctgtgcacccagataggacaatctgttgtagcattggagtaattaaagcagtatggtgctataacaagacagatgggcagagcagggtagaatgcaaggaacaaaaattttcgtatgtgaaaaaggtggcattacgattaggagggagtgagggccaagtcagcaaattattctggagcagttgattagcccttgttctctcacgccatacgtgaaaacttaattctgcatggaatcagcgtcagcgacagacatccatgggggcctgtgtgcaccatcttaggtggagaaatgagcagcaacaatggatggaatggaccctgggctagatagaatctggcagtctatgtggcagaaatcagcaaaaacacgattgtaaaagcaaacaagtaattagagaaatcacgtgctgtcaggtcttggaatcaattagaaagagatgactagccagatggaattgcagcccaatcatgtgaacaggcaaaccgcaaaaaataaataaaattaccaataaatacatgaaaaattataatgttgttagtagttaaaatgcgaattaaaatacatgctgttttccctaccagacaagcaaagagtaaattaaaatagtagcccaggcttgcctggcagtggcagggaggtgtggctgccagggccttagaggttggcatcaggctgcccaccccagtcactgccagagcctcccacctgagtgttcctcccggcactggaagccagtggccgtccagaggaacgtgattgaattgctgtatatccatctggtggagcactgctgtgtgtctgttaaaaaagaaaccataggtttttagggatatgtaatgatatttagaaagggtttaagagacagtaaagcttggcagaataaaccgtgtatacagaatggatgtttgcttgcataaataaatttatataaatatgtctgggggataaaaataagtatatcacaatgctaagacaggcatatggggaatttaagcttttctttatacttgtccatagtttccaatttttaaatttgtaattttttatcagaaaaataaatgtgtaaatatagtggaatctttattaaaacattcacttttatttgctatttcagaagttactgctttgcttattttttacaacatttctgtggtaaataatcggtgacttacaagcctagtgcagccagtgatgggggttggcaaacggtgacatgcaggggccatgcggcgtctagtgtctgtttctgtgttgaatttgtgtagcaacagagcaagtatttctcctgaaactcagactcactcaggccacctcagcccttctagttcctttcgtttattatagagtaacctacagcaggaataccgcgttcatttactgttaatagaagatccacaaaagattttgaaatcaaatacattctaaaactaggcaagacacgctgcaactccccttgtcctctgggttatgaggggtgagcgttggtttccgtgtgctcagatcccatgaatgagacctcacagggaagcgcccagtgactggcaggctccttaatgcctccaggtcaggctcaggaagtctctggatgcctgggtagagtctgggtcttctcagagcgggaggcacccagggcctgtggaggcctgagggctgctctggggttccagggccccagatagtggcttagcatcctggtgacacagaagggagagcactcaccgcggtcccacgtgtgtgttttgaagcctaagatgtttgcaatgactctcaacagtcgctttgaccttttcccctagatctttagcagttaaggagtttttttcaaagcccaagtataaccacattttgaaaccagaagactgtctctctgaaccgtgcactatattgcagttggacatgagaaccgtgcaaatttctgatctagagaccctgaggggcgagctgcgcttcgacatcaggaaggcggggaccctgcacggcttcacggcctggtttagcgtccacttccagagcctgcaggaggggcagccgccgcaggtgctcagcaccgggcccttccaccccaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctgtgttagtggtgcccttactgccgtcgctcatccactcgtgtgggacgtaggattgcacagggctgtgccagtggcgtgtagggaacactgccctggctcagcgtgcgagctaaggtggcgatgtatgcgatgggactctgcatgggatagtacagttgtgtagacgtcttccaaataaattatgtgttggtgcatcgcacatgctcaataaatatttttaaatgagtga

SEQ ID NO: 361567 - DNA, 3146 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaaatctttagcagttaaggagtttttttcaaagcccaagtataaccacattttgaaaccagaagactgtctctctgaaccgtgcactatattgcagttggacatgagaaccgtgcaaatttctgatctagagaccctgaggggcgagctgcgcttcgacatcaggaaggcggggaccctgcacggcttcacggcctggtttagcgtccacttccagagcctgcaggaggggcagccgccgcaggtgctcagcaccgggcccttccaccccaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctgtgttagtggtgcccttactgccgtcgctcatccactcgtgtgggacgtaggattgcacagggctgtgccagtggcgtgtagggaacactgccctggctcagcgtgcgagctaaggtggcgatgtatgcgatgggactctgcatgggatagtacagttgtgtagacgtcttccaaataaattatgtgttggtgcatcgcacatgctcaataaatatttttaaatgagtgaatgtcattgtgtatcctgttttatgcatatatgttattttttgtaattacaggatcatactatatgcattgctttataagtttttctcaatattgtgaaaaaacttccacatcagtagatacatgtccataatttttttttgtattgttttgatttttattaaattttattgaaatataggctgggtgcagtggcttacctctgtaatcccaacactttgagaggctgaggtgggatgattccttgagctcaggagttcaagaccaccctgggcaacacagcgagatactatctctacaaaaaaaatagaaaaattagctgggcatggtggcgtgtgcctgtagtcccagctactcgggaggctgaggcggggggatcacttgagcccaggaggttgaggctgcagtgatctaggattgcactgctgcactccagcgtgggtgacagagcaagaccctgtctcaaaaaccccaaaaaacaaaactgaaatatcaaatatatattgaaaacagtgctagtcatgggtacatagatgatggcattttataaagtggacgcacatgtaaccagcatccaggccaggacacactacagattccccgattccccttccactcagtgcccaccctctcaagggtgatgtcctgacttgtaactgtcgattactcttgcctgaatggagttgtacacgtgttcttttgtgtctgccttctttaattaaacattgtttgtgagactcatctatgaattttagacagtgtggttgtggttgactttttcattgtggcatagtattcaactgcatgaatagaccacagtttatgatcttgtttcacatggtgtccttttgggttgttgccatggtttagctatgatgattactgagactgtggacatttctgtgtatgtgttttggtgcatgtatgtacacatttctgttgggtgtacactgtataccaggttttcaagtcaaggaatctaatatccctgccagctgtgcatgagagttggc

SEQ ID NO: 361568 - DNA, 2382 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagagcagtgtgtggattacactatcactggaaaaatacgaattgagaagaaggaaaagactggaagatgcagaccttggttcctgttagtggaaacactgtaaggtcccagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaagtaagtgtccacagctgggactggcaccgtcttgtggggcctcctggtccacagtctgcaggtgggccaaggccctgggagatcccatacgacggttggataaatgagggtacctgtgcacccagataggacaatctgttgtagcattggagtaattaaagcagtatggtgctataacaagacagatgggcagagcagggtagaatgcaaggaacaaaaattttcgtatgtgaaaaaggtggcattacgattaggagggagtgagggccaagtcagcaaattattctggagcagttgattagcccttgttctctcacgccatacgtgaaaacttaattctgcatggaatcagcgtcagcgacagacatccatgggggcctgtgtgcaccatcttaggtggagaaatgagcagcaacaatggatggaatggaccctgggctagatagaatctggcagtctatgtggcagaaatcagcaaaaacacgattgtaaaagcaaacaagtaattagagaaatcacgtgctgtcaggtcttggaatcaattagaaagagatgactagccagatggaattgcagcccaatcatgtgaacaggcaaaccgcaaaaaataaataaaattaccaataaatacatgaaaaattataatgttgttagtagttaaaatgcgaattaaaatacatgctgttttccctaccagacaagcaaagagtaaattaaaatagtagcccaggcttgcctggcagtggcagggaggtgtggctgccagggccttagaggttggcatcaggctgcccaccccagtcactgccagagcctcccacctgagtgttcctcccggcactggaagccagtggccgtccagaggaacgtgattgaattgctgtatatccatctggtggagcactgctgtgtgtctgttaaaaaagaaaccataggtttttagggatatgtaatgatatttagaaagggtttaagagacagtaaagcttggcagaataaaccgtgtatacagaatggatgtttgcttgcataaataaatttatataaatatgtctgggggataaaaataagtatatcacaatgctaagacaggcatatggggaatttaagcttttctttatacttgtccatagtttccaatttttaaatttgtaattttttatcagaaaaataaatgtgtaaatatagtggaatctttattaaaacattcacttttatttgctatttca

SEQ ID NO: 361569 - DNA, 3866 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaagtaagtgtccacagctgggactggcaccgtcttgtggggcctcctggtccacagtctgcaggtgggccaaggccctgggagatcccatacgacggttggataaatgagggtacctgtgcacccagataggacaatctgttgtagcattggagtaattaaagcagtatggtgctataacaagacagatgggcagagcagggtagaatgcaaggaacaaaaattttcgtatgtgaaaaaggtggcattacgattaggagggagtgagggccaagtcagcaaattattctggagcagttgattagcccttgttctctcacgccatacgtgaaaacttaattctgcatggaatcagcgtcagcgacagacatccatgggggcctgtgtgcaccatcttaggtggagaaatgagcagcaacaatggatggaatggaccctgggctagatagaatctggcagtctatgtggcagaaatcagcaaaaacacgattgtaaaagcaaacaagtaattagagaaatcacgtgctgtcaggtcttggaatcaattagaaagagatgactagccagatggaattgcagcccaatcatgtgaacaggcaaaccgcaaaaaataaataaaattaccaataaatacatgaaaaattataatgttgttagtagttaaaatgcgaattaaaatacatgctgttttccctaccagacaagcaaagagtaaattaaaatagtagcccaggcttgcctggcagtggcagggaggtgtggctgccagggccttagaggttggcatcaggctgcccaccccagtcactgccagagcctcccacctgagtgttcctcccggcactggaagccagtggccgtccagaggaacgtgattgaattgctgtatatccatctggtggagcactgctgtgtgtctgttaaaaaagaaaccataggtttttagggatatgtaatgatatttagaaagggtttaagagacagtaaagcttggcagaataaaccgtgtatacagaatggatgtttgcttgcataaataaatttatataaatatgtctgggggataaaaataagtatatcacaatgctaagacaggcatatggggaatttaagcttttctttatacttgtccatagtttccaatttttaaatttgtaattttttatcagaaaaataaatgtgtaaatatagtggaatctttattaaaacattcacttttatttgctatttcagaagttactgctttgcttattttttacaacatttctgtggtaaataatcggtgacttacaagcctagtgcagccagtgatgggggttggcaaacggtgacatgcaggggccatgcggcgtctagtgtctgtttctgtgttgaatttgtgtagcaacagagcaagtatttctcctgaaactcagactcactcaggccacctcagcccttctagttcctttcgtttattatagagtaacctacagcaggaataccgcgttcatttactgttaatagaagatccacaaaagattttgaaatcaaatacattctaaaactaggcaagacacgctgcaactccccttgtcctctgggttatgaggggtgagcgttggtttccgtgtgctcagatcccatgaatgagacctcacagggaagcgcccagtgactggcaggctccttaatgcctccaggtcaggctcaggaagtctctggatgcctgggtagagtctgggtcttctcagagcgggaggcacccagggcctgtggaggcctgagggctgctctggggttccagggccccagatagtggcttagcatcctggtgacacagaagggagagcactcaccgcggtcccacgtgtgtgttttgaagcctaagatgtttgcaatgactctcaacagtcgctttgaccttttcccctagatctttagcagttaaggagtttttttcaaagcccaagtataaccacattttgaaaccagaagactgtctctctgaaccgtgcactatattgcagttggacatgagaaccgtgcaaatttctgatctagagaccctgaggggcgagctgcgcttcgacatcaggaaggcggggaccctgcacggcttcacggcctggtttagcgtccacttccagagcctgcaggaggggcagccgccgcaggtgctcagcaccgggcccttccaccccaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctgtgttagtggtgcccttactgtcgggctagtcgggggggtacccgagctc

SEQ ID NO: 361570 - DNA, 2873 bp, Homo sapiens
tggccctctcgcttcctgcccccttctcaccccccttcactggccacctgttccaaccctccatgatcctgttcctcccgagggcatcttaggagggcagggtcctgcgcgcactgcggcctccactccgaccccgtcccagtttggacccaggtcttccaatgaaaatataattatgcaaatcagtaagcatttgtaactacgaatatcacaaaaataagcttcaagtctggatttagaagtgaagcatgcattttaaacaaagaattgctatgcaattttaaaaacacattgatcccagagcagtgtgtggattacactatcactggaaaaatacgaattgagaagaaggaaaagactggaagatgcagaccttggttcctgttagtggaaacactgtaaggtcccaggtagggacttttaattggaattaaagctatcacacttctaagaaattaatgaatactgatttattgccttaagtcgacacctgatctaacagaaactaacaggcttcagcaaatgaacaagattaacaccttgcagactagtgaagaaaacacactatttgaagtttatgatttttaaatgcttttgtctctgtaaagtattgtaaattttcatttctacactaatcttcacacatacacattttacttctatttggtagaggacatcatgcacattagaagttaagtgaactcaattattaagcaatgtaacaagtactttgtgtctccttctctttttaaaagtagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaagtaagtgtccacagctgggactggcaccgtcttgtggggcctcctggtccacagtctgcaggtgggccaaggccctgggagatcccatacgacggttggataaatgagggtacctgtgcacccagataggacaatctgttgtagcattggagtaattaaagcagtatggtgctataacaagacagatgggcagagcagggtagaatgcaaggaacaaaaattttcgtatgtgaaaaaggtggcattacgattaggagggagtgagggccaagtcagcaaattattctggagcagttgattagcccttgttctctcacgccatacgtgaaaacttaattctgcatggaatcagcgtcagcgacagacatccatgggggcctgtgtgcaccatcttaggtggagaaatgagcagcaacaatggatggaatggaccctgggctagatagaatctggcagtctatgtggcagaaatcagcaaaaacacgattgtaaaagcaaacaagtaattagagaaatcacgtgctgtcaggtcttggaatcaattagaaagagatgactagccagatggaattgcagcccaatcatgtgaacaggcaaaccgcaaaaaataaataaaattaccaataaatacatgaaaaattataatgttgttagtagttaaaatgcgaattaaaatacatgctgttttccctaccagacaagcaaagagtaaattaaaatagtagcccaggcttgcctggcagtggcagggaggtgtggctgccagggccttagaggttggcatcaggctgcccaccccagtcactgccagagcctcccacctgagtgttcctcccggcactggaagccagtggccgtccagaggaacgtgattgaattgctgtatatccatctggtggagcactgctgtgtgtctgttaaaaaagaaaccataggtttttagggatatgtaatgatatttagaaagggtttaagagacagtaaagcttggcagaataaaccgtgtatacagaatggatgtttgcttgcataaataaatttatataaatatgtctgggggataaaaataagtatatcacaatgctaagacaggcatatggggaatttaagcttttctttatacttgtccatagtttccaatttttaaatttgtaattttttatcagaaaaataaatgtgtaaatatagtggaatctttattaaaacattcacttttatttgctatttca

SEQ ID NO: 361571 - DNA, 2337 bp, Homo sapiens
  misc_feature (32)..(32): n is a, c, g, or t
  misc_feature (42)..(42): n is a, c, g, or t
  misc_feature (44)..(44): n is a, c, g, or t
  misc_feature (46)..(46): n is a, c, g, or t
  misc_feature (51)..(51): n is a, c, g, or t
aagtcatcctggacgtgggctgtgggactggnatcatcagtntntnctgtncacactatgcgcggcctagagcggtgtacgcggtggaggccagtaagatggcacagcacacggggcagctggtcctgcagaacggctttcctgacatcatcaccgtgtaccagcagagactggaagatgcagaccttggttcctgttagtggaaacactgtaaggtcccagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaagtaagtgtccacagctgggactggcaccgtcttgtggggcctcctggtccacagtctgcaggtgggccaaggccctgggagatcccatacgacggttggataaatgagggtacctgtgcacccagataggacaatctgttgtagcattggagtaattaaagcagtatggtgctataacaagacagatgggcagagcagggtagaatgcaaggaacaaaaattttcgtatgtgaaaaaggtggcattacgattaggagggagtgagggccaagtcagcaaattattctggagcagttgattagcccttgttctctcacgccatacgtgaaaacttaattctgcatggaatcagcgtcagcgacagacatccatgggggcctgtgtgcaccatcttaggtggagaaatgagcagcaacaatggatggaatggaccctgggctagatagaatctggcagtctatgtggcagaaatcagcaaaaacacgattgtaaaagcaaacaagtaattagagaaatcacgtgctgtcaggtcttggaatcaattagaaagagatgactagccagatggaattgcagcccaatcatgtgaacaggcaaaccgcaaaaaataaataaaattaccaataaatacatgaaaaattataatgttgttagtagttaaaatgcgaattaaaatacatgctgttttccctaccagacaagcaaagagtaaattaaaatagtagcccaggcttgcctggcagtggcagggaggtgtggctgccagggccttagaggttggcatcaggctgcccaccccagtcactgccagagcctcccacctgagtgttcctcccggcactggaagccagtggccgtccagaggaacgtgattgaattgctgtatatccatctggtggagcactgctgtgtgtctgttaaaaaagaaaccataggtttttagggatatgtaatgatatttagaaagggtttaagagacagtaaagcttggcagaataaaccgtgtatacagaatggatgtttgcttgcataaataaatttatataaatatgtctgggggataaaaataagtatatcacaatgctaagacaggcatatggggaatttaagcttttctttatacttgtccatagtttccaatttttaaatttgtaattttttatcagaaaaataaatgtgtaaatatagtggaatctttattaaaacattcacttttatttgctatttca

SEQ ID NO: 361572 - DNA, 2132 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaagtaagtgtccacagctgggactggcaccgtcttgtggggcctcctggtccacagtctgcaggtgggccaaggccctgggagatcccatacgacggttggataaatgagggtacctgtgcacccagataggacaatctgttgtagcattggagtaattaaagcagtatggtgctataacaagacagatgggcagagcagggtagaatgcaaggaacaaaaattttcgtatgtgaaaaaggtggcattacgattaggagggagtgagggccaagtcagcaaattattctggagcagttgattagcccttgttctctcacgccatacgtgaaaacttaattctgcatggaatcagcgtcagcgacagacatccatgggggcctgtgtgcaccatcttaggtggagaaatgagcagcaacaatggatggaatggaccctgggctagatagaatctggcagtctatgtggcagaaatcagcaaaaacacgattgtaaaagcaaacaagtaattagagaaatcacgtgctgtcaggtcttggaatcaattagaaagagatgactagccagatggaattgcagcccaatcatgtgaacaggcaaaccgcaaaaaataaataaaattaccaataaatacatgaaaaattataatgttgttagtagttaaaatgcgaattaaaatacatgctgttttccctaccagacaagcaaagagtaaattaaaatagtagcccaggcttgcctggcagtggcagggaggtgtggctgccagggccttagaggttggcatcaggctgcccaccccagtcactgccagagcctcccacctgagtgttcctcccggcactggaagccagtggccgtccagaggaacgtgattgaattgctgtatatccatctggtggagcactgctgtgtgtctgttaaaaaagaaaccataggtttttagggatatgtaatgatatttagaaagggtttaagagacagtaaagcttggcagaataaaccgtgtatacagaatggatgtttgcttgcataaataaatttatataaatatgtctgggggtggtagttctagatcgcgagcggccgct

SEQ ID NO: 361573 - DNA, 1909 bp, Homo sapiens
  misc_feature (9)..(9): n is a, c, g, or t
  misc_feature (21)..(21): n is a, c, g, or t
  misc_feature (34)..(34): n is a, c, g, or t
  misc_feature (36)..(36): n is a, c, g, or t
ggccagtgntgcctgcggttnatggggggggggnantttcccttccccttggtgtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaagtaagtgtccacagctgggactggcaccgtcttgtggggcctcctggtccacagtctgcaggtgggccaaggccctgggagatcccatacgacggttggataaatgagggtacctgtgcacccagataggacaatctgttgtagcattggagtaattaaagcagtatggtgctataacaagacagatgggcagagcagggtagaatgcaaggaacaaaaattttcgtatgtgaaaaaggtggcattacgattaggagggagtgagggccaagtcagcaaattattctggagcagttgattagcccttgttctctcacgccatacgtgaaaacttaattctgcatggaatcagcgtcagcgacagacatccatgggggcctgtgtgcaccatcttaggtggagaaatgagcagcaacaatggatggaatggaccctgggctagatagaatctggcagtctatgtggcagaaatcagcaaaaacacgattgtaaaagcaaacaagtaattagagaaatcacgtgctgtcaggtcttggaatcaattagaaagagatgactagccagatggaattgcagcccaatcatgtgaacaggcaaaccgcaaaaaataaataaaattaccaataaatacatgaaaaattataatgttgttagtagttaaaatgcgaattaaaatacatgctgttttccctaccagacaagcaaagagtaaattaaaatagtagcccaggcttgcctggcagtggcagggaggtgtggctgccagggccttagaggttggcatcaggctgcccaccccagtcactgccagagcctcccacctgagtgttcctcccggcactggaagccagtggccgtccagaggaacgtgattgaattgctgtatatccatctggtggagcactgctgtgtgtctgttaaaaaagaaaccataggtttttagggatatgtaatgatatttagaaagggtttaagagacagtaaagcttggcagaataaaccgtgtatacagaatggatgtttgcttgcataaataaatttatataaatatgtctgggggataaaaataagtatatcacaatgctaagacaggcatatggggaatttaagcttttctttatacttgtccatagtttccaatttttaaatttgtaattttttatcagaaaaataaatgtgtaaatatagtggaatctttattaaaacattcacttttatttgctatttca

SEQ ID NO: 361574 - DNA, 1500 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaaatctttagcagttaaggagtttttttcaaagcccaagtataaccacattttgaaaccagaagactgtctctctgaaccgtgcactatattgcagttggacatgagaaccgtgcaaatttctgatctagaggtgagaaaaagatgaattgctccttacattcgataatcagtgaccacgaaacactcagaccagagcctggcttatcaaaaaccttcagtgagtgctgggggtgtgagtgaataactaattattttattatgcaaataagtgaatttataaaacgtttgctactgattttttccagtcttttttcttttttacgttctattttgattctttcatattgtacaccattttatgtctccagcgtcttcattttagatttatgtttaatattctcagcatcttcaaaatcaaataaattatatttcgtttcattatggtaaaaaattaca

SEQ ID NO: 361575 - DNA, 1927 bp, Homo sapiens
  misc_feature (1927)..(1927): n is a, c, g, or t
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaaatctttagcagttaaggagtttttttcaaagcccaagtataaccacattttgaaaccagaagactgtctctctgaaccgtgcactatattgcagttggacatgagaaccgtgcaaatttctgatctagagaccctgaggggcgagctgcgcttcgacatcaggaaggcggggaccctgcacggcttcacggcctggtttagcgggtacagtggatatagttgccatcaatgagcccttcattgacctcaaactacatggattttacatgttccacatatgattccacccatggcaaattccatggcaccgacaaggctgagaacgggaagcttgtcatcaatggacatccatcaccatcttccaaggaacgagatccctcccaaaatcacgtgggagcggaatgctggcgctgagtacgtccgtgggagtcaactgggagtcttcagcagcatgggagaaggctgaggtcatttgcaggggggaggccaaaagggtcatacacatctgccctctgcttgaatgcccaagtcggcatggttgtgaacaatggaacggatgtacaaaggcgtgcagagacatgagaaagcgcacgggaaacacaacagggaagcaaacacggaccaggccaagcaggacaagcagggagaagggaaaggacaagacccacaggcaaggaagaaggggcggcacaaagagagtaaagggcccaggaaaagagagtcaaggacgggagagcacagaaacaacacgcagcactggagacagagaggcgacgtacagacaaggagaatgaggcaacaacccacgaagatgcgaagcagcagaaacaacaaagcggagagccagacgcagagtacgctagctggtacgaaacgactaagn

SEQ ID NO: 361576 - DNA, 2760 bp, Homo sapiens
caaaacctggaaacaacccaagtgtccttcatctggataatccttaaggataaactggtgcgtccacacagtggaataccactgagcagtgaagaggagccagttattgaaacaggtaatttggaggaaccccagaaacggtacagtgagtgaaagaaacttgtcttgaaaggttatgtactgtttggttccatttgtatgatattctcaaaaagacacaagaccatggggatggagaccagatcggtggctggagaggctggggtcggggagggcatgaccaccagagaaaagggtgaagagtgttttgggtggcagagctgtgtgtatgctggctgtggttgtgaggacaaaatccacacaagcgctcaagttcgtaggctgtacgccagaaaagctgtttcactacataactgaaaaaataagattgaaaaataagatgtatatattttttgtgtgcgtgtgtagaaaaatacttgaaggtaaactgcagagtgataacagtggtttcttctaggtactgggttaatatgtgatttttatgtttgtttgagcttttctaagttttctacattttccgtacaaaacatgtattacttctgtaataaaagcagcttgagattatttaaggaagcaaaacacttctgttgtttctcatcaactacaggatgaagtgcaggctccctgggtggtttgcaggggccacaggccttggccccacctcgctggtgctccctctactcctttctgtgtttgaagcaagttctggttcagacagaaagcctggcctttgaagggcgttgggtccccacttcctcagtcatagatgtgatgtgcttcccttgacttgggaccttctgagggatgcaaggtggaccaaaggacccgtgaatggccagggcatgcctgcgtggctttcggtttcttaagcagtgatttcagtccacttaaagggtgtgaaaattctgagaatgctacggaccaaatatattttatgtaacagttgggacccggcaacacttcagggctctttcaaaatctggtagctacgagctcttccgtgactgagatgggacaagagtgaagatttgtccttgcttttagctctgctccagttcatagttctaatgggaaattatgtgacttaaacccaggctgtgagatgcatcagtgacgtgtgggcataaaataaaccctcgagatgttctcttgcatggtacactggcctaggcaggaatattcttgaggctaaaactgtagaactgtcagactagtgttacgaatgtggtggtgagaggcctgtgcagccgcggggcctgtgatgtgtctcctgtgtgtctttcactcctatgcagtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaagtaagtgtccacagctgggactggcaccgtcttgtggggcctcctggtccacagtctgcaggtgggccaaggccctgggagatcccatacgacggttggataaatgagggtacctgtgcacccagataggacaatctgttgtagcattggagtaattaaagcagtatggtgctataacaagacagatgggcagagcagggtagaatgcaaggaacaaaaattttcgtatgtgaaaaaggtggcattacgattaggagggagtgagggccaagtcagcaaattattctggagcagttgattagcccttgttctctcacgccatacgtgaaaacttaattctgcatggaatcagcgtcagcgacagacatccatgggggcctgtgtgcaccatcttaggtggagaaatgagcagcaacaatggatggaatggaccctgggctagatagaatctggcagtctatgtggcagaaatcagcaaaaacacgattgtaaaagcaaacaagtaattagagaaatcacgtgctgtcaggtcttggaatcaattagaaagagatgactagccagatggaattgcagcccaatcatgtgaacaggcaaaccgcaaaaaataaataaaattaccaataaatacatgaaaaattataatgttgttagtagttaaaatgcgaattaaaatacatgctgttttccctaccagacaagcaaagagtaaattaaaatagtagcccaggcttgcctggcagtggcagggaggtgtggctgccagggccttagaggttggcatcaggctgcccaccccagtcactgccagagcctcccacctgagtgttcctcccggcactggaagccagtggccgtccagaggaacgtgattgaattgctgtatatccatctggtggagcactgctgtgtgtctgttaaaaaagaaaccataggtttttagggatatgtaatgatatttagaaagggtttaagagacagtaaagcttggcagaataaaccgtgtatacagaatggatgtttgcttgcataaataaatttatataaatatgtctgggggataaaaataagtatatcacaatgctaagacaggcatatggggaatttaagcttttctttatacttgtccatagtttccaatttttaaatttgtaattttttatcagaaaaataaatgtgtaaatatagtggaatctttattaaaacattcacttttatttgctatttca

SEQ ID NO: 361577 - DNA, 1018 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgggtgagggcgggcgtgcgggcagctgggggccggagctggggggcttctgagcacgggctcggctgggccaacctcaggatctcaagggtcgtgcgtgattcattttgatgttttccctaatgtgaggtctaattaatttcttgtgtgga

SEQ ID NO: 361578 - DNA, 1115 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgggtgagggcgggcgtgcgggcagctgggggccggagctggggggcttctgagcacgggctcggctgggccaacctcaggatctcaagggtcgtgcgtgattcattttgatgttttccctaatgtgaggtctaattaatttcttgtgtggacattggctcagtgtcttgaattttcacctgatttaaaaaatgcctttatgagaaatttaagtcaaagttcatgtaacattttcatgagtgatttaca

SEQ ID NO: 361579 - DNA, 1239 bp, Homo sapiens
tctccaactccttaactggaagagctgagcgccgaaaagattccgcagaatctggggtagaaaattgggcgcaagaagctcagatgcttgaaacgtttctgactgaagcctctgaactcacgatgcgggttttgggggtggtttccccaggctggggggcttttctacggttcctgacgcattcagcgtctgcgcggggcgcgtggagggggccgccccaacccgggccctgcggtgccacgcggtgcccacgcgtgccttgtcatctgcttgacccagaccctgaggggcgagctgcgcttcgacatcaggaaggcggggaccctgcacggcttcacggcctggtttagcgtccacttccagagcctgcaggaggggcagccgccgcaggtgctcagcaccgggcccttccaccccaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctgtgttagtggtgcccttactgccgtcgctcatccactcgtgtgggacgtaggattgcacagggctgtgccagtggcgtgtagggaacactgccctggctcagcgtgcgagctaaggtggcgatgtatgcgatgggactctgcatgggatagtacagttgtgtagacgtcttccaaataaattatgtgttggtgcatcgcacatgctcaataaatatttttaaatgagtga

SEQ ID NO: 361580 - DNA, 1382 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagagcagtgtgtggattacactatcactggaaaaatacgaattgagaagaaggaaaagactggaagatgcagaccttggttcctgttagtggaaacactgtaaggtcccagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctgtgttagtggtgcccttactgccgtcgctcatccactcgtgtgggacgtaggattgcacagggctgtgccagtggcgtgtagggaacactgccctggctcagcgtgcgagctaaggtggcgatgtatgcgatgggactctgcatgggatagtacagttgtgtagacgtcttccaaataaattatgtgttggtgcatcgcacatgctcaataaatatttttaaatgagtga

SEQ ID NO: 361581 - DNA, 1871 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaaaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctgtgttagtggtgcccttactgccgtcgctcatccactcgtgtgggacgtaggattgcacagggctgtgccagtggcgtgtagggaacactgccctggctcagcgtgcgagctaaggtggcgatgtatgcgatgggactctgcatgggatagtacagttgtgtagacgtcttccaaataaattatgtgttggtgcatcgcacatgctcaataaatatttttaaatgagtgaatgtcattgtgtatcctgttttatgcatatatgttattttttgtaattacaggatcatactatatgcattgctttataagtttttctcaatattgtgaaaaaacttccacatcagtagatacatgtccataatttttttttgtattgttttgatttttattaaattttattgaaatataggctgggtgcagtggcttacctctgtaatcccaacactttgagaggctgaggtgggatgattccttgagctcaggagttcaagaccaccctgggcaacacagcgagatactatctctacaaaaaaaatagaaaaattagctgggcatggtggcgtgtgcctgtagtcccagctactcgggaggctgaggcggggggatcacttgagcccaggaggttgaggctgcagtgatctaggattgcactgctgcactccagcgtgggtgacagagcaagaccctgtctcaaaaaccccaaaaaacaaaactgaaatatcaaatatatattgaaaacagtgctagtcatgggtacatagatgatggcattttataaagtggacgcacatgtaaccagcatccaggccaggacacactacagattccccgattccccttccactcagtgcccaccctctcaagggtgatgtcctgacttgtaactgtcgattactcttgcctgaatggagttgtacacgtgttcttttgtgtctgccttctttaattaaacattgtttgtgagactcatctatgaattttagacagtgtggttgtggttgactttttcattgtggcatagtattcaactgcatgaatagaccacagtttatgatcttgtttcacatggtgtccttttgggttgttgccatggtttagctatgatgattactgagactgtggacatttctgtgtatgtgttttggtgcatgtatgtacacatttctgttgggtgtacactgtataccaggttttcaagtcaaggaatctaatatccctgccagctgtgcatgagagttggc

SEQ ID NO: 361582 - DNA, 363 bp, Homo sapiens
gtgtgtgaattcatgtgtagctcgcccagctcacttgggcttcctgtctcagaggctgctgaaaatggaatgttcttctttgggctcaggattaatgtggcaaagaaaataaaaataaatggttttccttcattttttatatttgttttgtgctttgctttgtgataagtttttgttaaaagtttgtcatttaaaaaaattctgcacctgaatactgttctcttgtccaatattaaaccattaggaaatgtagtatgttaatcaaatgatttatcatctgattgacctgttgtcatttatctttttcaggttggagaaaaagtcttccccatctggagatgacagttgatgctttatttggaa

SEQ ID NO: 361583 - DNA, 2134 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaaatctttagcagttaaggagtttttttcaaagcccaagtataaccacattttgaaaccagaagactgtctctctgaaccgtgcactatattgcagttggacatgagaaccgtgcaaatttctgatctagagaccctgaggggcgagctgcgcttcgacatcaggaaggcggggaccctgcacggcttcacggcctggtttagcgtccacttccagagcctgcaggaggggcagccgccgcaggtgctcagcaccgggcccttccaccccaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctgtgttagtggtgcccttactgccgtcgctcatccactcgtgtgggacgtaggattgcacagggctgtgccagtggcgtgtagggaacactgccctggctcagcgtgcgagctaaggtggcgatgtatgcgatgggactctgcatgggatagtacagttgtgtagacgtcttccaaataaattatgtgttggtgcatcgcacatgctcaataaatatttttaaatgagtga

SEQ ID NO: 361584 - DNA, 2273 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaagtaagtgtccacagctgggactggcaccgtcttgtggggcctcctggtccacagtctgcaggtgggccaaggccctgggagatcccatacgacggttggataaatgagggtacctgtgcacccagataggacaatctgttgtagcattggagtaattaaagcagtatggtgctataacaagacagatgggcagagcagggtagaatgcaaggaacaaaaattttcgtatgtgaaaaaggtggcattacgattaggagggagtgagggccaagtcagcaaattattctggagcagttgattagcccttgttctctcacgccatacgtgaaaacttaattctgcatggaatcagcgtcagcgacagacatccatgggggcctgtgtgcaccatcttaggtggagaaatgagcagcaacaatggatggaatggaccctgggctagatagaatctggcagtctatgtggcagaaatcagcaaaaacacgattgtaaaagcaaacaagtaattagagaaatcacgtgctgtcaggtcttggaatcaattagaaagagatgactagccagatggaattgcagcccaatcatgtgaacaggcaaaccgcaaaaaataaataaaattaccaataaatacatgaaaaattataatgttgttagtagttaaaatgcgaattaaaatacatgctgttttccctaccagacaagcaaagagtaaattaaaatagtagcccaggcttgcctggcagtggcagggaggtgtggctgccagggccttagaggttggcatcaggctgcccaccccagtcactgccagagcctcccacctgagtgttcctcccggcactggaagccagtggccgtccagaggaacgtgattgaattgctgtatatccatctggtggagcactgctgtgtgtctgttaaaaaagaaaccataggtttttagggatatgtaatgatatttagaaagggtttaagagacagtaaagcttggcagaataaaccgtgtatacagaatggatgtttgcttgcataaataaatttatataaatatgtctgggggataaaaataagtatatcacaatgctaagacaggcatatggggaatttaagcttttctttatacttgtccatagtttccaatttttaaatttgtaattttttatcagaaaaataaatgtgtaaatatagtggaatctttattaaaacattcacttttatttgctatttca

SEQ ID NO: 361585 - DNA, 2874 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaaatctttagcagttaaggagtttttttcaaagcccaagtataaccacattttgaaaccagaagactgtctctctgaaccgtgcactatattgcagttggacatgagaaccgtgcaaatttctgatctagagaccctgaggggcgagctgcgcttcgacatcaggaaggcggggaccctgcacggcttcacggcctggtttagcgtccacttccagagcctgcaggaggggcagccgccgcaggtgctcagcaccgggcccttccaccccaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctgtgttagtggtgcccttactgccgtcgctcatccactcgtgtgggacgtaggattgcacagggctgtgccagtggcgtgtagggaacactgccctggctcagcgtgcgagctaaggtggcgatgtatgcgatgggactctgcatgggatagtacagttgtgtagacgtcttccaaataaattatgtgttggtgcatcgcacatgctcaataaatatttttaaatgagtgaatgtcattgtgtatcctgttttatgcatatatgttattttttgtaattacaggatcatactatatgcattgctttataagtttttctcaatattgtgaaaaaacttccacatcagtagatacatgtccataatttttttttgtattgttttgatttttattaaattttattgaaatataggctgggtgcagtggcttacctctgtaatcccaacactttgagaggctgaggtgggatgattccttgagctcaggagttcaagaccaccctgggcaacacagcgagatactatctctacaaaaaaaatagaaaaattagctgggcatggtggcgtgtgcctgtagtcccagctactcgggaggctgaggcggggggatcacttgagcccaggaggttgaggctgcagtgatctaggattgcactgctgcactccagcgtgggtgacagagcaagaccctgtctcaaaaaccccaaaaaacaaaactgaaatatcaaatatatattgaaaacagtgctagtcatgggtacatagatgatggcattttataaagtggacgcacatgtaaccagcatccaggccaggacacactacagattccccgattccccttccactcagtgcccaccctctcaagggtgatgtcctgacttgtaactgtcgattactcttgcctgaatggagttgtacacgtgttcttttgtgtctgccttctttaattaaacattgtttgtgagactca

SEQ ID NO: 361586 - DNA, 2243 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagagcagtgtgtggattacactatcactggaaaaatacgaattgagaagaaggaaaagactggaagatgcagaccttggttcctgttagtggaaacactgtaaggtcccagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaaatctttagcagttaaggagtttttttcaaagcccaagtataaccacattttgaaaccagaagactgtctctctgaaccgtgcactatattgcagttggacatgagaaccgtgcaaatttctgatctagagaccctgaggggcgagctgcgcttcgacatcaggaaggcggggaccctgcacggcttcacggcctggtttagcgtccacttccagagcctgcaggaggggcagccgccgcaggtgctcagcaccgggcccttccaccccaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctgtgttagtggtgcccttactgccgtcgctcatccactcgtgtgggacgtaggattgcacagggctgtgccagtggcgtgtagggaacactgccctggctcagcgtgcgagctaaggtggcgatgtatgcgatgggactctgcatgggatagtacagttgtgtagacgtcttccaaataaattatgtgttggtgcatcgcacatgctcaataaatatttttaaatgagtga

SEQ ID NO: 361587 - DNA, 3412 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaagtaagtgtccacagctgggactggcaccgtcttgtggggcctcctggtccacagtctgcaggtgggccaaggccctgggagatcccatacgacggttggataaatgagggtacctgtgcacccagataggacaatctgttgtagcattggagtaattaaagcagtatggtgctataacaagacagatgggcagagcagggtagaatgcaaggaacaaaaattttcgtatgtgaaaaaggtggcattacgattaggagggagtgagggccaagtcagcaaattattctggagcagttgattagcccttgttctctcacgccatacgtgaaaacttaattctgcatggaatcagcgtcagcgacagacatccatgggggcctgtgtgcaccatcttaggtggagaaatgagcagcaacaatggatggaatggaccctgggctagatagaatctggcagtctatgtggcagaaatcagcaaaaacacgattgtaaaagcaaacaagtaattagagaaatcacgtgctgtcaggtcttggaatcaattagaaagagatgactagccagatggaattgcagcccaatcatgtgaacaggcaaaccgcaaaaaataaataaaattaccaataaatacatgaaaaattataatgttgttagtagttaaaatgcgaattaaaatacatgctgttttccctaccagacaagcaaagagtaaattaaaatagtagcccaggcttgcctggcagtggcagggaggtgtggctgccagggccttagaggttggcatcaggctgcccaccccagtcactgccagagcctcccacctgagtgttcctcccggcactggaagccagtggccgtccagaggaacgtgattgaattgctgtatatccatctggtggagcactgctgtgtgtctgttaaaaaagaaaccataggtttttagggatatgtaatgatatttagaaagggtttaagagacagtaaagcttggcagaataaaccgtgtatacagaatggatgtttgcttgcataaataaatttatataaatatgtctgggggataaaaataagtatatcacaatgctaagacaggcatatggggaatttaagcttttctttatacttgtccatagtttccaatttttaaatttgtaattttttatcagaaaaataaatgtgtaaatatagtggaatctttattaaaacattcacttttatttgctatttcagaagttactgctttgcttattttttacaacatttctgtggtaaataatcggtgacttacaagcctagtgcagccagtgatgggggttggcaaacggtgacatgcaggggccatgcggcgtctagtgtctgtttctgtgttgaatttgtgtagcaacagagcaagtatttctcctgaaactcagactcactcaggccacctcagcccttctagttcctttcgtttattatagagtaacctacagcaggaataccgcgttcatttactgttaatagaagatccacaaaagattttgaaatcaaatacattctaaaactaggcaagacacgctgcaactccccttgtcctctgggttatgaggggtgagcgttggtttccgtgtgctcagatcccatgaatgagacctcacagggaagcgcccagtgactggcaggctccttaatgcctccaggtcaggctcaggaagtctctggatgcctgggtagagtctgggtcttctcagagcgggaggcacccagggcctgtggaggcctgagggctgctctggggttccagggccccagatagtggcttagcatcctggtgacacagaagggagagcactcaccgcggtcccacgtgtgtgttttgaagcctaagatgtttgcaatgactctcaacagtcgctttgaccttttcccctagatctttagcagttaaggagtttttttcaaagcccaagtataaccacattttgaaaccagaagactgtctctctgaaccgtgcactatattgcagttggacatgagaaccgtgcaaatttctgatctagaggtgagaaaaagatgaattgctccttacattcgataatcagtgaccacgaaacactcagaccagagcctggcttatcaaaaaccttcagtgagtgctgggggtgtgagtgaataactaattattttattatgcaaataagtgaatttataaaacgtttgctactgattttttccagtcttttttcttttttacgttctattttgattctttcatattgtacaccattttatgtctccagcgtcttcattttagatttatgtttaatattctcagcatcttcaaaatcaaataaattatatttcgtttcattatggtaaaaaattaca

SEQ ID NO: 361588 - DNA, 2332 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgaggtaggtgtcctgatgggcagctcagatggctggactgcacgtaaggaaggacaggccagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaagtaagtgtccacagctgggactggcaccgtcttgtggggcctcctggtccacagtctgcaggtgggccaaggccctgggagatcccatacgacggttggataaatgagggtacctgtgcacccagataggacaatctgttgtagcattggagtaattaaagcagtatggtgctataacaagacagatgggcagagcagggtagaatgcaaggaacaaaaattttcgtatgtgaaaaaggtggcattacgattaggagggagtgagggccaagtcagcaaattattctggagcagttgattagcccttgttctctcacgccatacgtgaaaacttaattctgcatggaatcagcgtcagcgacagacatccatgggggcctgtgtgcaccatcttaggtggagaaatgagcagcaacaatggatggaatggaccctgggctagatagaatctggcagtctatgtggcagaaatcagcaaaaacacgattgtaaaagcaaacaagtaattagagaaatcacgtgctgtcaggtcttggaatcaattagaaagagatgactagccagatggaattgcagcccaatcatgtgaacaggcaaaccgcaaaaaataaataaaattaccaataaatacatgaaaaattataatgttgttagtagttaaaatgcgaattaaaatacatgctgttttccctaccagacaagcaaagagtaaattaaaatagtagcccaggcttgcctggcagtggcagggaggtgtggctgccagggccttagaggttggcatcaggctgcccaccccagtcactgccagagcctcccacctgagtgttcctcccggcactggaagccagtggccgtccagaggaacgtgattgaattgctgtatatccatctggtggagcactgctgtgtgtctgttaaaaaagaaaccataggtttttagggatatgtaatgatatttagaaagggtttaagagacagtaaagcttggcagaataaaccgtgtatacagaatggatgtttgcttgcataaataaatttatataaatatgtctgggggataaaaataagtatatcacaatgctaagacaggcatatggggaatttaagcttttctttatacttgtccatagtttccaatttttaaatttgtaattttttatcagaaaaataaatgtgtaaatatagtggaatctttattaaaacattcacttttatttgctatttca

SEQ ID NO: 361589 - DNA, 2232 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagagcagtgtgtggattacactatcactggaaaaatacgaattgagaagaaggaaaggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaagtaagtgtccacagctgggactggcaccgtcttgtggggcctcctggtccacagtctgcaggtgggccaaggccctgggagatcccatacgacggttggataaatgagggtacctgtgcacccagataggacaatctgttgtagcattggagtaattaaagcagtatggtgctataacaagacagatgggcagagcagggtagaatgcaaggaacaaaaattttcgtatgtgaaaaaggtggcattacgattaggagggagtgagggccaagtcagcaaattattctggagcagttgattagcccttgttctctcacgccatacgtgaaaacttaattctgcatggaatcagcgtcagcgacagacatccatgggggcctgtgtgcaccatcttaggtggagaaatgagcagcaacaatggatggaatggaccctgggctagatagaatctggcagtctatgtggcagaaatcagcaaaaacacgattgtaaaagcaaacaagtaattagagaaatcacgtgctgtcaggtcttggaatcaattagaaagagatgactagccagatggaattgcagcccaatcatgtgaacaggcaaaccgcaaaaaataaataaaattaccaataaatacatgaaaaattataatgttgttagtagttaaaatgcgaattaaaatacatgctgttttccctaccagacaagcaaagagtaaattaaaatagtagcccaggcttgcctggcagtggcagggaggtgtggctgccagggccttagaggttggcatcaggctgcccaccccagtcactgccagagcctcccacctgagtgttcctcccggcactggaagccagtggccgtccagaggaacgtgattgaattgctgtatatccatctggtggagcactgctgtgtgtctgttaaaaaagaaaccataggtttttagggatatgtaatgatatttagaaagggtttaagagacagtaaagcttggcagaataaaccgtgtatacagaatggatgtttgcttgcataaataaatttatataaatatgtctgggggataaaaataagtatatcacaatgctaagacaggcatatggggaatttaagcttttctttatacttgtccatagtttccaatttttaaatttgtaattttttatcagaaaaataaatgtgtaaatatagtggaatctttattaaaacattcacttttatttgctatttca

SEQ ID NO: 361590 - DNA, 2213 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaagtaagtgtccacagctgggactggcaccgtcttgtggggcctcctggtccacagtctgcaggtgggccaaggccctgggagatcccatacgacggttggataaatgagggtacctgtgcacccagataggacaatctgttgtagcattggagtaattaaagcagtatggtgctataacaagacagatgggcagagcagggtagaatgcaaggaacaaaaattttcgtatgtgaaaaaggtggcattacgattaggagggagtgagggccaagtcagcaaattattctggagcagttgattagcccttgttctctcacgccatacgtgaaaacttaattctgcatggaatcagcgtcagcgacagacatccatgggggcctgtgtgcaccatcttaggtggagaaatgagcagcaacaatggatggaatggaccctgggctagatagaatctggcagtctatgtggcagaaatcagcaaaaacacgattgtaaaagcaaacaagtaattagagaaatcacgtgctgtcaggtcttggaatcaattagaaagagatgactagccagatggaattgcagcccaatcatgtgaacaggcaaaccgcaaaaaataaataaaattaccaataaatacatgaaaaattataatgttgttagtagttaaaatgcgaattaaaatacatgctgttttccctaccagacaagcaaagagtaaattaaaatagtagcccaggcttgcctggcagtggcagggaggtgtggctgccagggccttagaggttggcatcaggctgcccaccccagtcactgccagagcctcccacctgagtgttcctcccggcactggaagccagtggccgtccagaggaacgtgattgaattgctgtatatccatctggtggagcactgctgtgtgtctgttaaaaaagaaaccataggtttttagggatatgtaatgatatttagaaagggtttaagagacagtaaagcttggcagaataaaccgtgtatacagaatggatgtttgcttgcataaataaatttatataaatatgtctgggggataaaaataagtatatcacaatgctaagacaggcatatggggaatttaagcttttctttatacttgtccatagtttccaatttttaaatttgtaattttttatcagaaaaataaatgtgtaaatatagtggaatctttattaaaacattcacttttatttgctatttca

SEQ ID NO: 361591 - DNA, 1519 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctggttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctgtgttagtggtgcccttactgccgtcgctcatccactcgtgtgggacgtaggattgcacagggctgtgccagtggcgtgtagggaacactgccctggctcagcgtgcgagctaaggtggcgatgtatgcgatgggactctgcatgggatagtacagttgtgtagacgtcttccaaataaattatgtgttggtgcatcgcacatgctcaataaatatttttaaatgagtga

SEQ ID NO: 361592 - DNA, 2621 bp, Homo sapiens
caaaacctggaaacaacccaagtgtccttcatctggataatccttaaggataaactggtgcgtccacacagtggaataccactgagcagtgaagaggagccagttattgaaacaggtaatttggaggaaccccagaaacggtacagtgagtgaaagaaacttgtcttgaaaggttatgtactgtttggttccatttgtatgatattctcaaaaagacacaagaccatggggatggagaccagatcggtggctggagaggctggggtcggggagggcatgaccaccagagaaaagggtgaagagtgttttgggtggcagagctgtgtgtatgctggctgtggttgtgaggacaaaatccacacaagcgctcaagttcgtaggctgtacgccagaaaagctgtttcactacataactgaaaaaataagattgaaaaataagatgtatatattttttgtgtgcgtgtgtagaaaaatacttgaaggtaaactgcagagtgataacagtggtttcttctaggtactgggttaatatgtgatttttatgtttgtttgagcttttctaagttttctacattttccgtacaaaacatgtattacttctgtaataaaagcagcttgagattatttaaggaagcaaaacacttctgttgtttctcatcaactacaggatgaagtgcaggctccctgggtggtttgcaggggccacaggccttggccccacctcgctggtgctccctctactcctttctgtgtttgaagcaagttctggttcagacagaaagcctggcctttgaagggcgttgggtccccacttcctcagtcatagatgtgatgtgcttcccttgacttgggaccttctgagggatgcaaggtggaccaaaggacccgtgaatggccagggcatgcctgcgtggctttcggtttcttaagcagtgatttcagtccacttaaagggtgtgaaaattctgagaatgctacggaccaaatatattttatgtaacagttgggacccggcaacacttcagggctctttcaaaatctggtagctacgagctcttccgtgactgagatgggacaagagtgaagatttgtccttgcttttagctctgctccagttcatagttctaatgggaaattatgtgacttaaacccaggctgtgagatgcatcagtgacgtgtgggcataaaataaaccctcgagatgttctcttgcatggtacactggcctaggcaggaatattcttgaggctaaaactgtagaactgtcagactagtgttacgaatgtggtggtgagaggcctgtgcagccgcggggcctgtgatgtgtctcctgtgtgtctttcactcctatgcagtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaaatctttagcagttaaggagtttttttcaaagcccaagtataaccacattttgaaaccagaagactgtctctctgaaccgtgcactatattgcagttggacatgagaaccgtgcaaatttctgatctagagaccctgaggggcgagctgcgcttcgacatcaggaaggcggggaccctgcacggcttcacggcctggtttagcgtccacttccagagcctgcaggaggggcagccgccgcaggtgctcagcaccgggcccttccaccccaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctgtgttagtggtgcccttactgccgtcgctcatccactcgtgtgggacgtaggattgcacagggctgtgccagtggcgtgtagggaacactgccctggctcagcgtgcgagctaaggtggcgatgtatgcgatgggactctgcatgggatagtacagttgtgtagacgtcttccaaataaattatgtgttggtgcatcgcacatgctcaataaatatttttaaatgagtga

SEQ ID NO: 361593 - DNA, 1801 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctggctgcgcctctcctgagctgccgcattctcccctgcacctgtgcgtctggccctcttcacgtcctcctggcctgctgtctgcctctcccctgcacctgtgcgtctgtccctcttcatgtcctccttgcctgctgtctgcctgttctcagagcccctcagccctcaggccttcatctctcctggcccatcttcctactctgacgctgacatgtagtaaaagtctgaagacagagaagagtgcatgtgcgtttagcataggaggggcagctttcagtcagtgcagcaagggcatgtagttgttcagagatggtgctggaacgactgatttggagaaaagaggcccttcttcacaccatctgctaaaataaacctcagatgggctcaagagttaaatatttaagaaaaggaggaaacaaaaaaattgctacaagtttatttgttgttaggatgggaaaggtttttctaagaaccaagttcataatgaagctgtcaaataaaatacttgacaaaaaattccccttcatacattagcacagctaaaaactattaaatggtaaatgcaactaaagaattgcagctaaagaattgtgtgacgtaaagagttgcaataagaaaagcataagataaaggtaacctcatggaaggtgagcagggactagaaaggcagagaaatgccagaggccaggagcttgaacgttgttcaatgccaccaacaatttgaaagtaactgtaatagttttgacctgggaagttggctgagcaatcctctaatatctgatgctcccgatgctgaggttgtggggaagtgtgcaccgccatgccctttttttggcagtgtaaattggtaaagccttttgaaggaaaatagggcagaataagtcaaagagcattaaaatttttttgtttttccagaagcagcaaagttctgaagga

SEQ ID NO: 361594 - DNA, 844 bp, Homo sapiens
acacgcacccctgtcttgcagcaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctgtgttagtggtgcccttactgccgtcgctcatccactcgtgtgggacgtaggattgcacagggctgtgccagtggcgtgtagggaacactgccctggctcagcgtgcgagctaaggtggcgatgtatgcgatgggactctgcatgggatagtacagttgtgtagacgtcttccaaataaattatgtgttggtgcatcgcacatgctcaataaatatttttaaatgagtga

SEQ ID NO: 361595 - DNA, 824 bp, Homo sapiens
gcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagagcagtgtgtggattacactatcactggaaaaatacgaattgagaagaaggaaaagactggaagatgcagaccttggttcctgttagtggaaacactgtaaggtcccagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgtgggcaggctgcccacgagtgatggttttaggaaaaaggtgttggttgggttgaagttaccacaatgattaggtcattttctagttctttctgtggcaacatttgggaagcttagaaagtgacttgcggccgggcgtggtggctcatgcctgtgatcccagcacttcgtgtcag

SEQ ID NO: 361596 - DNA, 5865 bp, Homo sapiens
ggagtgcggcttactggcaggcggcgcaggcggccgctgccaaaggggaagtgatctggggctggagcgatggcccggggctggagctcgcggccgccgccgccgcagccgccgccaccaacgccaacaacaacgtgtcgggagcagccgcggccgaagccggagcaggggccggagtcgcggctggagtggggcctgcgcgtgtgagtggccgagagttgcccgtgccggagacctcaaactccgggcgggagcgctttcggtcggccgagccgccgtcgcccgcggcaccgtgtccccaaggcccagacagcggggcgggggtctatcaggcgcgggactggcttctctcaggccgacccttctagccgggctccggatcttcctcggcctcgggcccccttcacgttcaggacggaggccggagaacggtgatcatcacacaccccagccggcttcctggccagggcattttctctgcggccaagcagtgttgggattgtagctgctgggagccccctcctgccgccacctctcctgcaaggaagggactgacgcgttcccactttcttactctgcacctccccactctcttcccattcaagaacgagtttctcttccctctccattggaaatcctgctccggaggtccaaaacacgtattttaagcgtgcccttcctcacctcctggagcacccttagaagtattgcctacttatccgggctgagaatccttcatttttgacctggcttttttttcgccctttgggagataaaggtccctctccaccctctactaacactctgcacccaaggccttatcctttggggtcaccagctccttggccatttctatgtgatttcccccacccatctgagttccagtttcctctgggctccaatctccagtccctggcggatctggtcagtcccacccctaggtgggagtgaccagggggctctggcccaggattcccaaccctggaaggcagctccaaggcaggaagagaattgggcatcgggtacgaacctggcagctcaggagtcggggctccactcaccccacacaaaaagatgaaaaagcgcaaagagctcaatgcattgattggtttggctggggacagccggagaaagaagcccaagaaaggcccaagcagtcaccgcctgcttcgcactgagcctcccgactcagactctgagtccagctccgaagaggaagaggaattcggtgtggttggaaatcgctctcgctttgccaagggagactatttacgatgctgcaagatctgttatccgctctgtggttttgtcatccttgctgcctgtgttgtggcctgtgttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacaggatatcctgtaccttcacaactctttagaggaggtaaacagtgccctagtggggtaccagagacagaatgatcttaaactcgagggaatgaacgagacagtcagtaatcttacccagagagtcaacctgatagaaagcgatgtggttgctatgagcaaggtagaaaagaaagcaaacctgtccttcagcatgatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactgagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 361597 - DNA, 476 bp, Homo sapiens
gcggccgcgagctccagccccgggccttcgctccagccccagatcacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 361598 - DNA, 546 bp, Homo sapiens
ttgtaaggtggtaagagcatgaaattctgcctaaagtggtctagtcacaaggtgaagcaagatatttcggaaagttatttagttagtgtgaaatagctcctagaaaacaagatcctgctcatttaggaaatgggtgtcgcataggcacctgagcaagggtacatttcctttactgctgacacatgcattccttcccccatcaaccaaatgttcacagtgaatcagatcatctgtagcataatgttcccttaatggtttcaaatccagcaagatacttatcagtgctgaggaccaaagacatcaccagtatatgttgattcattcttttattgtctttatagggaacctactgagggtcaaacactacatgctaaacaggctctgggaatacagtggacacttagatgaagtcttactaccaccttaaaccttctataatctttgttttgtgcagaaagaagatagttcaaattctcaggtatccaagctaagagagaaactccagcctgggcaacagagcaagactctgtcttgggtaaaaaaaaa

SEQ ID NO: 361599 - DNA, 5811 bp, Homo sapiens
ggagtgcggcttactggcaggcggcgcaggcggccgctgccaaaggggaagtgatctggggctggagcgatggcccggggctggagctcgcggccgccgccgccgcagccgccgccaccaacgccaacaacaacgtgtcgggagcagccgcggccgaagccggagcaggggccggagtcgcggctggagtggggcctgcgcgtgtgagtggccgagagttgcccgtgccggagacctcaaactccgggcgggagcgctttcggtcggccgagccgccgtcgcccgcggcaccgtgtccccaaggcccagacagcggggcgggggtctatcaggcgcgggactggcttctctcaggccgacccttctagccgggctccggatcttcctcggcctcgggcccccttcacgttcaggacggaggccggagaacggtgatcatcacacaccccagccggcttcctggccagggcattttctctgcggccaagcagtgttgggattgtagctgctgggagccccctcctgccgccacctctcctgcaaggaagggactgacgcgttcccactttcttactctgcacctccccactctcttcccattcaagaacgagtttctcttccctctccattggaaatcctgctccggaggtccaaaacacgtattttaagcgtgcccttcctcacctcctggagcacccttagaagtattgcctacttatccgggctgagaatccttcatttttgacctggcttttttttcgccctttgggagataaaggtccctctccaccctctactaacactctgcacccaaggccttatcctttggggtcaccagctccttggccatttctatgtgatttcccccacccatctgagttccagtttcctctgggctccaatctccagtccctggcggatctggtcagtcccacccctaggtgggagtgaccagggggctctggcccaggattcccaaccctggaaggcagctccaaggcaggaagagaattgggcatcgggtacgaacctggcagctcaggagtcggggctccactcaccccacacaaaaagatgaaaaagcgcaaagagctcaatgcattgattggtttggctggggacagccggagaaagaagcccaagaaaggcccaagcagtcaccgcctgcttcgcactgagcctcccgactcagactctgagtccagctccgaagaggaagaggaattcggtgtggttggaaatcgctctcgctttgccaagggagactatttacgatgctgcaagatctgttatccgctctgtggttttgtcatccttgctgcctgtgttgtggcctgtgttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacaggatatcctgtaccttcacaactctttagaggaggtaaacagtgccctagtggggtaccagagacagaatgatcttaaactcgagggaatgaacgagacagtcagtaatcttacccagagagtcaacctgatagaaagcgatgtggttgctatgagcaaggtagaaaagaaagcaaacctgtccttcagcatgatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactgagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 361600 - DNA, 5811 bp, Homo sapiens
ggagtgcggcttactggcaggcggcgcaggcggccgctgccaaaggggaagtgatctggggctggagcgatggcccggggctggagctcgcggccgccgccgccgcagccgccgccaccaacgccaacaacaacgtgtcgggagcagccgcggccgaagccggagcaggggccggagtcgcggctggagtggggcctgcgcgtgtgagtggccgagagttgcccgtgccggagacctcaaactccgggcgggagcgctttcggtcggccgagccgccgtcgcccgcggcaccgtgtccccaaggcccagacagcggggcgggggtctatcaggcgcgggactggcttctctcaggccgacccttctagccgggctccggatcttcctcggcctcgggcccccttcacgttcaggacggaggccggagaacggtgatcatcacacaccccagccggcttcctggccagggcattttctctgcggccaagcagtgttgggattgtagctgctgggagccccctcctgccgccacctctcctgcaaggaagggactgacgcgttcccactttcttactctgcacctccccactctcttcccattcaagaacgagtttctcttccctctccattggaaatcctgctccggaggtccaaaacacgtattttaagcgtgcccttcctcacctcctggagcacccttagaagtattgcctacttatccgggctgagaatccttcatttttgacctggcttttttttcgccctttgggagataaaggtccctctccaccctctactaacactctgcacccaaggccttatcctttggggtcaccagctccttggccatttctatgtgatttcccccacccatctgagttccagtttcctctgggctccaatctccagtccctggcggatctggtcagtcccacccctaggtgggagtgaccagggggctctggcccaggattcccaaccctggaaggcagctccaaggcaggaagagaattgggcatcgggtacgaacctggcagctcaggagtcggggctccactcaccccacacaaaaagatgaaaaagcgcaaagagctcaatgcattgattggtttggctggggacagccggagaaagaagcccaagaaaggcccaagcagtcaccgcctgcttcgcactgagcctcccgactcagactctgagtccagctccgaagaggaagaggaattcggtgtggttggaaatcgctctcgctttgccaagggagactatttacgatgctgcaagatctgttatccgctctgtggttttgtcatccttgctgcctgtgttgtggcctgtgttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacaggatatcctgtaccttcacaactctttagaggaggtaaacagtgccctagtggggtaccagagacagaatgatcttaaactcgagggaatgaacgagacagtcagtaatcttacccagagagtcaacctgatagaaagcgatgtggttgctatgagcaaggtagaaaagaaagcaaacctgtccttcagcatgatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaactcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactgagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 361601 - DNA, 5024 bp, Homo sapiens
agaattctatgcctaaatagcagaacggaagcctcattttattttgattaaattcctattttaatacatacattgcatcagtcagtgagtcagtgagtatttattgagccccttcaggatacaaagtagtgctctggtagagctattgagtttgaaatattagtcacatttttaaaccaaaaccaaatccccaagtagttgaaagtgctgttcaaattgtcagagtgcagttcctgtagactgtattttgtgagatgggcttttactttatatgttcccacttgggcaggaacaaaagtttggtaaattactgaggtattacattttaccaaaatgaaattttgaagtgatccttcatcattagctttcttcctgtccaattgttgagggagtgtgtgataattacagcatcttttgagtaatttaagattttgggatcttgtgctgccaggacagggtaaagaataacacttgccttcactctttgacactagtgttcaaattgggcagggaaagaaggggtattattgttgcctcccagatcccaactctatccaaagtactgtctcctttacttctgtgagctgacagggttgcagaaacacataaaatcctagactatcttgacatcaccaaccgtagagtttgtgaaggtaacgtgtcctctacaaattctcatttgttttcattgtttgttactcttttttgttcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacaggatatcctgtaccttcacaactctttagaggaggtaaacagtgccctagtggggtaccagagacagaatgatcttaaactcgagggaatgaacgagacagtcagtaatcttacccagagagtcaacctgatagaaagcgatgtggttgctatgagcaaggtagaaaagaaagcaaacctgtccttcagcatgatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactgagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 361602 - DNA, 4636 bp, Homo sapiens
gacccacgcgtccgcgctctcgcttgccaagggagactatttacgatgctgcaagatctgttatccgctctgtggttttgtcatccttgctgcctgtgttgtggcctgtgttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacaggatatcctgtaccttcacaactctttagaggaggtaaacagtgccctagtggggtaccagagacagaatgatcttaaactcgagggaatgaacgagacagtcagtaatcttacccagagagtcaacctgatagaaagcgatgtggttgctatgagcaaggtagaaaagaaagcaaacctgtccttcagcatgatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactgagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 361603 - DNA, 4302 bp, Homo sapiens
tccttctcacggattactcaagaacaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacagatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactgagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 361604 - DNA, 4990 bp, Homo sapiens
ggagtgcggcttactggcaggcggcgcaggcggccgctgccaaaggggaagtgatctggggctggagcgatggcccggggctggagctcgcggccgccgccgccgcagccgccgccaccaacgccaacaacaacgtgtcgggagcagccgcggccgaagccggagcaggggccggagtcgcggctggagtggggcctgcgcgtgtgagtggccgagagttgcccgtgccggagacctcaaactccgggcgggagcgctttcggtcggccgagccgccgtcgcccgcggcaccgtgtccccaaggcccagacagcggggcgggggtctatcaggcgcgggactggcttctctcaggccgacccttctagccgggctccggatcttcctcggcctcgggcccccttcacgttcaggacggaggccggagaacggtgatcatcacacaccccagccggcttcctggccagggcattttctctgcggccaagcagtgttgggattgtagctgctgggagccccctcctgccgccacctctcctgcaaggaagggactgacgcgttcccactttcttactctgcacctccccactctcttcccattcaagaacgagtttctcttccctctccattggaaatcctgctccggaggtccaaaacacgtattttaagcgtgcccttcctcacctcctggagcacccttagaagtattgcctacttatccgggctgagaatccttcatttttgacctggcttttttttcgccctttgggagataaaggtccctctccaccctctactaacactctgcacccaaggccttatcctttggggtcaccagctccttggccatttctatgtgatttcccccacccatctgagttccagtttcctctgggctccaatctccagtccctggcggatctggtcagtcccacccctaggtgggagtgaccagggggctctggcccaggattcccaaccctggaaggcagctccaaggcaggaagagaattgggcatcgggtacgaacctggcagctcaggagtcggggctccactcaccccacacaaaaagatgaaaaagcgcaaagagctcaatgcattgattggtttggctggggacagccggagaaagaagcccaagaaaggcccaagcagtcaccgcctgcttcgcactgagcctcccgactcagactctgagtccagctccgaagaggaagaggaattcggtgtggttggaaatcgctctcgctttgccaagggagactatttacgatgctgcaagatctgttatccgctctgtggttttgtcatccttgctgcctgtgttgtggcctgtgttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacaggatatcctgtaccttcacaactctttagaggaggtaaacagtgccctagtggggtaccagagacagaatgatcttaaactcgagggaatgaacgagacagtcagtaatcttacccagagagtcaacctgatagaaagcgatgtggttgctatgagcaaggtagaaaagaaagcaaacctgtccttcagcatgatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattataaaaaaaaaaaaaaaaaaaaaaaaaaaaaaaaaaaaaaaaaaaaaaaaaagggggggggcgcccaaaaattcccccgggggggcccattttaggggttcccacgtttttgtgtgagccacaagggggccccattaggagggaggcgcgtatataaacagaccaaggcagctgggcacgacgtattaacaacaggtctggtagagggggaaaacgggctcaactggcggaaaatctgggaagagaggaaccctaactacagggggggggaacaaatatttgtggcgacaaacaatctatccttcatagaggagagtgttatttaaagagcactacaggaaggggggaaaaatattataaacacaatttacagagacgggggtttatataagtggttgtgtgcttaaaacaataaaacgaggggcaaaaatagatgctagggtagggtaatgaaaaaaaatttttgccgctatacaccggggagattttatatactttttgagagacaaatttttttttatcaccggggagg

SEQ ID NO: 361605 - DNA, 4171 bp, Homo sapiens
ttgtaaggtggtaagagcatgaaattctgcctaaagtggtctagtcacaaggtgaagcaagatatttcggaaagttatttagttagtgtgaaatagctcctagaaaacaagatcctgctcatttaggaaatgggtgtcgcataggcacctgagcaagggtacatttcctttactgctgacacatgcattccttcccccatcaaccaaatgttcacagtgaatcagatcatctgtagcataatgttcccttaatggtttcaaatccagcaagatacttatcagtgctgaggaccaaagacatcaccagtatatgttgattcattcttttattgtctttatagggaacctactgagggtcaaacactacatgctaaacaggctctgggaatacagtggacacttagatgaagtcttactaccaccttaaaccttctataatctttgttttgtgcagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactgagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 361606 - DNA, 3663 bp, Homo sapiens
aatatatttttaagggatcaaaaattagtcttcctgatttagtgaaatcctaaactttaccatttggaaacaaaatttgcggagtagcttttcttttagtgttttaaattcagttgagactacttttaactaaatttagctgtatgtttagacgtatacattttttgtaattcatttttgacagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactgagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 361607 - DNA, 3320 bp, Homo sapiens
cggcacgagcggcacgagcggcacgagcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactgagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 361608 - DNA, 2411 bp, Homo sapiens
  misc_feature (14)..(14): n is a, c, g, or t
  misc_feature (16)..(16): n is a, c, g, or t
ttcccaatatatcngnctatccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactgagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 361609 - DNA, 2368 bp, Homo sapiens
ccgctgcacttgatgaaccgctcgcgagggtagtattgtacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactgagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 361610 - DNA, 2426 bp, Homo sapiens
aacgtgttatctctcgcgaacgtgttatccctcgcgaacgtgttatctctcgcgaacgtgttatccctcgcgaacgtgttatcactcgcgaacgtgttatccctcgcgaacgtgttatctctcgcaaacgtgttatcccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactgagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 361611 - DNA, 3477 bp, Homo sapiens
ggagtgcggcttactggcaggcggcgcaggcggccgctgccaaaggggaagtgatctggggctggagcgatggcccggggctggagctcgcggccgccgccgccgcagccgccgccaccaacgccaacaacaacgtgtcgggagcagccgcggccgaagccggagcaggggccggagtcgcggctggagtggggcctgcgcgtgtgagtggccgagagttgcccgtgccggagacctcaaactccgggcgggagcgctttcggtcggccgagccgccgtcgcccgcggcaccgtgtccccaaggcccagacagcggggcgggggtctatcaggcgcgggactggcttctctcaggccgacccttctagccgggctccggatcttcctcggcctcgggcccccttcacgttcaggacggaggccggagaacggtgatcatcacacaccccagccggcttcctggccagggcattttctctgcggccaagcagtgttgggattgtagctgctgggagccccctcctgccgccacctctcctgcaaggaagggactgacgcgttcccactttcttactctgcacctccccactctcttcccattcaagaacgagtttctcttccctctccattggaaatcctgctccggaggtccaaaacacgtattttaagcgtgcccttcctcacctcctggagcacccttagaagtattgcctacttatccgggctgagaatccttcatttttgacctggcttttttttcgccctttgggagataaaggtccctctccaccctctactaacactctgcacccaaggccttatcctttggggtcaccagctccttggccatttctatgtgatttcccccacccatctgagttccagtttcctctgggctccaatctccagtccctggcggatctggtcagtcccacccctaggtgggagtgaccagggggctctggcccaggattcccaaccctggaaggcagctccaaggcaggaagagaattgggcatcgggtacgaacctggcagctcaggagtcggggctccactcaccccacacaaaaagatgaaaaagcgcaaagagctcaatgcattgattggtttggctggggacagccggagaaagaagcccaagaaaggcccaagcagtcaccgcctgcttcgcactgagcctcccgactcagactctgagtccagctccgaagaggaagaggaattcggtgtggttggaaatcgctctcgctttgccaagggagactatttacgatgctgcaagatctgttatccgctctgtggttttgtcatccttgctgcctgtgttgtggcctgtgttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacaggatatcctgtaccttcacaactctttagaggaggtaaacagtgccctagtggggtaccagagacagaatgatcttaaactcgagggaatgaacgagacagtcagtaatcttacccagagagtcaacctgatagaaagcgatgtggttgctatgagcaaggtagaaaagaaagcaaacctgtccttcagcatgatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaactgcttggggatcctctagtcagc

SEQ ID NO: 361612 - DNA, 1314 bp, Homo sapiens
tacacacaacaatgagttaaggtgtcttcaaagtatctgcctatgaataagaatttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactgagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 361613 - DNA, 2521 bp, Homo sapiens
ggagtgcggcttactggcaggcggcgcaggcggccgctgccaaaggggaagtgatctggggctggagcgatggcccggggctggagctcgcggccgccgccgccgcagccgccgccaccaacgccaacaacaacgtgtcgggagcagccgcggccgaagccggagcaggggccggagtcgcggctggagtggggcctgcgcgtgtgagtggccgagagttgcccgtgccggagacctcaaactccgggcgggagcgctttcggtcggccgagccgccgtcgcccgcggcaccgtgtccccaaggcccagacagcggggcgggggtctatcaggcgcgggactggcttctctcaggccgacccttctagccgggctccggatcttcctcggcctcgggcccccttcacgttcaggacggaggccggagaacggtgatcatcacacaccccagccggcttcctggccagggcattttctctgcggccaagcagtgttgggattgtagctgctgggagccccctcctgccgccacctctcctgcaaggaagggactgacgcgttcccactttcttactctgcacctccccactctcttcccattcaagaacgagtttctcttccctctccattggaaatcctgctccggaggtccaaaacacgtattttaagcgtgcccttcctcacctcctggagcacccttagaagtattgcctacttatccgggctgagaatccttcatttttgacctggcttttttttcgccctttgggagataaaggtccctctccaccctctactaacactctgcacccaaggccttatcctttggggtcaccagctccttggccatttctatgtgatttcccccacccatctgagttccagtttcctctgggctccaatctccagtccctggcggatctggtcagtcccacccctaggtgggagtgaccagggggctctggcccaggattcccaaccctggaaggcagctccaaggcaggaagagaattgggcatcgggtacgaacctggcagctcaggagtcggggctccactcaccccacacaaaaagatgaaaaagcgcaaagagctcaatgcattgattggtttggctggggacagccggagaaagaagcccaagaaaggcccaagcagtcaccgcctgcttcgcactgagcctcccgactcagactctgagtccagctccgaagaggaagaggaattcggtgtggttggaaatcgctctcgctttgccaagggagactatttacgatgctgcaagatctgttatccgctctgtggttttgtcatccttgctgcctgtgttgtggcctgtgttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacaggatatcctgtaccttcacaactctttagaggaggtaaacagtgccctagtggggtaccagagacagaatgatcttaaactcgagggaatgaacgagacagtcagtaatcttacccagagagtcaacctgatagaaagcgatgtggttgctatgagcaaggtagaaaagaaagcaaacctgtccttcagcatgatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaaggtgagagcagagccggcttcttaatatttcatggaggcttgagcagcttgcctctcacatggggagcagggaaggtgttccagcagtactgatcgcaccaagcgagtgatgcctgaacgcaccgagatgaagctgatacactttgctttcatttagaaaaggcccattttgtacatgatttgtactctagtctattaagggaagaattggtaatgtttagctggaaatagaattctccatgctgtctgcatccaattatag

SEQ ID NO: 361614 - DNA, 451 bp, Homo sapiens
aagggaattcgtgctggtgctaagggaattcgtgctggtgctaagggaatccgtgctggtgctttgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 361615 - DNA, 347 bp, Homo sapiens
agagtgcgagggacaaagcaaagacagacgattgatggtcaaaaccaggaaaaggagtttacttcagtacttgacatagtaatggttgttcggtgctgctggcctgcttgtctaatttacgtctttagtggattccataactttatttatttccactctaggatatcctgtaccttcacaactctttagaggaggtaaacagtgccctagtggggtaccagagacagaatgatcttaaactcgagggaatgaacgagacagtcagtaatcttacccagagagtcaacctgatagaaagcgatgtggttgctatgagcaaggtagaaaagaaagcaaacctgtccttc

SEQ ID NO: 361616 - DNA, 319 bp, Homo sapiens
gcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgcca

SEQ ID NO: 361617 - DNA, 6131 bp, Homo sapiens
ggagtgcggcttactggcaggcggcgcaggcggccgctgccaaaggggaagtgatctggggctggagcgatggcccggggctggagctcgcggccgccgccgccgcagccgccgccaccaacgccaacaacaacgtgtcgggagcagccgcggccgaagccggagcaggggccggagtcgcggctggagtggggcctgcgcgtgtgagtggccgagagttgcccgtgccggagacctcaaactccgggcgggagcgctttcggtcggccgagccgccgtcgcccgcggcaccgtgtccccaaggcccagacagcggggcgggggtctatcaggcgcgggactggcttctctcaggccgacccttctagccgggctccggatcttcctcggcctcgggcccccttcacgttcaggacggaggccggagaacggtgatcatcacacaccccagccggcttcctggccagggcattttctctgcggccaagcagtgttgggattgtagctgctgggagccccctcctgccgccacctctcctgcaaggaagggactgacgcgttcccactttcttactctgcacctccccactctcttcccattcaagaacgagtttctcttccctctccattggaaatcctgctccggaggtccaaaacacgtattttaagcgtgcccttcctcacctcctggagcacccttagaagtattgcctacttatccgggctgagaatccttcatttttgacctggcttttttttcgccctttgggagataaaggtccctctccaccctctactaacactctgcacccaaggccttatcctttggggtcaccagctccttggccatttctatgtgatttcccccacccatctgagttccagtttcctctgggctccaatctccagtccctggcggatctggtcagtcccacccctaggtgggagtgaccagggggctctggcccaggattcccaaccctggaaggcagctccaaggcaggaagagaattgggcatcgggtacgaacctggcagctcaggagtcggggctccactcaccccacacaaaaagatgaaaaagcgcaaagagctcaatgcattgattggtttggctggggacagccggagaaagaagcccaagaaaggcccaagcagtcaccgcctgcttcgcactgagcctcccgactcagactctgagtccagctccgaagaggaagaggaattcggtgtggttggaaatcgctctcgctttgccaagggagactatttacgatgctgcaagatctgttatccgctctgtggttttgtcatccttgctgcctgtgttgtggcctgtgttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacaggatatcctgtaccttcacaactctttagaggaggtaaacagtgccctagtggggtaccagagacagaatgatcttaaactcgagggaatgaacgagacagtcagtaatcttacccagagagtcaacctgatagaaagcgatgtggttgctatgagcaaggtagaaaagaaagcaaacctgtccttcagcatgatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactgagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaccttgggggggggcccgggccccaaattcccctaatggggggcggtttaaaaattaaggggcggatgtttaaaaacgtaggaaggggaaaaccctgggggttcccaacttaaaggccttggaaaaaaatcccctttttgaaggggggcttaaaacca

SEQ ID NO: 361618 - DNA, 4924 bp, Homo sapiens
  misc_feature (36)..(36): n is a, c, g, or t
gcggccgccgccgccgcagccgccgccaccaacgcnaaccctggaaggcagctccaaggcaggaagagaattgggcatcgggtacgaacctggcagctcaggagtcggggctccactcaccccacacaaaaagatgaaaaagcgcaaagagctcaatgcattgattggtttggctggggacagccggagaaagaagcccaagaaaggcccaagcagtcaccgcctgcttcgcactgagcctcccgactcagactctgagtccagctccgaagaggaagaggaattcggtgtggttggaaatcgctctcgctttgccaagggagactatttacgatgctgcaagatctgttatccgctctgtggttttgtcatccttgctgcctgtgttgtggcctgtgttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacaggatatcctgtaccttcacaactctttagaggaggtaaacagtgccctagtggggtaccagagacagaatgatcttaaactcgagggaatgaacgagacagtcagtaatcttacccagagagtcaacctgatagaaagcgatgtggttgctatgagcaaggtagaaaagaaagcaaacctgtccttcagcatgatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactgagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 361619 - DNA, 5673 bp, Homo sapiens
ggagtgcggcttactggcaggcggcgcaggcggccgctgccaaaggggaagtgatctggggctggagcgatggcccggggctggagctcgcggccgccgccgccgcagccgccgccaccaacgccaacaacaacgtgtcgggagcagccgcggccgaagccggagcaggggccggagtcgcggctggagtggggcctgcgcgtgtgagtggccgagagttgcccgtgccggagacctcaaactccgggcgggagcgctttcggtcggccgagccgccgtcgcccgcggcaccgtgtccccaaggcccagacagcggggcgggggtctatcaggcgcgggactggcttctctcaggccgacccttctagccgggctccggatcttcctcggcctcgggcccccttcacgttcaggacggaggccggagaacggtgatcatcacacaccccagccggcttcctggccagggcattttctctgcggccaagcagtgttgggattgtagctgctgggagccccctcctgccgccacctctcctgcaaggaagggactgacgcgttcccactttcttactctgcacctccccactctcttcccattcaagaacgagtttctcttccctctccattggaaatcctgctccggaggtccaaaacacgtattttaagcgtgcccttcctcacctcctggagcacccttagaagtattgcctacttatccgggctgagaatccttcatttttgacctggcttttttttcgccctttgggagataaaggtccctctccaccctctactaacactctgcacccaaggccttatcctttggggtcaccagctccttggccatttctatgtgatttcccccacccatctgagttccagtttcctctgggctccaatctccagtccctggcggatctggtcagtcccacccctaggtgggagtgaccagggggctctggcccaggattcccaaccctggaaggcagctccaaggcaggaagagaattgggcatcgggtacgaacctggcagctcaggagtcggggctccactcaccccacacaaaaagatgaaaaagcgcaaagagctcaatgcattgattggtttggctggggacagccggagaaagaagcccaagaaaggcccaagcagtcaccgcctgcttcgcactgagcctcccgactcagactctgagtccagctccgaagaggaagaggaattcggtgtggttggaaatcgctctcgctttgccaagggagactatttacgatgctgcaagatctgttatccgctctgtggttttgtcatccttgctgcctgtgttgtggcctgtgttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacagatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactgagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 361620 - DNA, 5811 bp, Homo sapiens
ggagtgcggcttactggcaggcggcgcaggcggccgctgccaaaggggaagtgatctggggctggagcgatggcccggggctggagctcgcggccgccgccgccgcagccgccgccaccaacgccaacaacaacgtgtcgggagcagccgcggccgaagccggagcaggggccggagtcgcggctggagtggggcctgcgcgtgtgagtggccgagagttgcccgtgccggagacctcaaactccgggcgggagcgctttcggtcggccgagccgccgtcgcccgcggcaccgtgtccccaaggcccagacagcggggcgggggtctatcaggcgcgggactggcttctctcaggccgacccttctagccgggctccggatcttcctcggcctcgggcccccttcacgttcaggacggaggccggagaacggtgatcatcacacaccccagccggcttcctggccagggcattttctctgcggccaagcagtgttgggattgtagctgctgggagccccctcctgccgccacctctcctgcaaggaagggactgacgcgttcccactttcttactctgcacctccccactctcttcccattcaagaacgagtttctcttccctctccattggaaatcctgctccggaggtccaaaacacgtattttaagcgtgcccttcctcacctcctggagcacccttagaagtattgcctacttatccgggctgagaatccttcatttttgacctggcttttttttcgccctttgggagataaaggtccctctccaccctctactaacactctgcacccaaggccttatcctttggggtcaccagctccttggccatttctatgtgatttcccccacccatctgagttccagtttcctctgggctccaatctccagtccctggcggatctggtcagtcccacccctaggtgggagtgaccagggggctctggcccaggattcccaaccctggaaggcagctccaaggcaggaagagaattgggcatcgggtacgaacctggcagctcaggagtcggggctccactcaccccacacaaaaagatgaaaaagcgcaaagagctcaatgcattgattggtttggctggggacagccggagaaagaagcccaagaaaggcccaagcagtcaccgcctgcttcgcactgagcctcccgactcagactctgagtccagctccgaagaggaagaggaattcggtgtggttggaaatcgctctcgctttgccaagggagactatttacgatgctgcaagatctgttatccgctctgtggttttgtcatccttgctgcctgtgttgtggcctgtgttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacaggatatcctgtaccttcacaactctttagaggaggtaaacagtgccctagtggggtaccagagacagaatgatcttaaactcgagggaatgaacgagacagtcagtaatcttacccagagagtcaacctgatagaaagcgatgtggttgctatgagcaaggtagaaaagaaagcaaacctgtccttcagcatgatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgcctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactgagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 361621 - DNA, 4052 bp, Homo sapiens
ctaccaccttttatccttcaaagccttaaagtttgtgactgaaacagctagaagcactagtttcaacttcgtctctggcctttctccctctctcctcccatctcccactcctctgcaatttctgttgagagtgttctgagatcctttaaataagtttgacgaatttgtttaaaagtgctaggtgttcaagttttaatgtttgcctttaatcttccctttgtttgtttgtttttgttttgccctttaagatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactgagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 361622 - DNA, 4460 bp, Homo sapiens
ggagtgcggcttactggcaggcggcgcaggcggccgctgccaaaggggaagtgatctggggctggagcgatggcccggggctggagctcgcggccgccgccgccgcagccgccgccaccaacgccaacaacaacgtgtcgggagcagccgcggccgaagccggagcaggggccggagtcgcggctggagtggggcctgcgcgtgtgagtggccgagagttgcccgtgccggagacctcaaactccgggcgggagcgctttcggtcggccgagccgccgtcgcccgcggcaccgtgtccccaaggcccagacagcggggcgggggtctatcaggcgcgggactggcttctctcaggccgacccttctagccgggctccggatcttcctcggcctcgggcccccttcacgttcaggacggaggccggagaacggtgatcatcacacaccccagccggcttcctggccagggcattttctctgcggccaagcagtgttgggattgtagctgctgggagccccctcctgccgccacctctcctgcaaggaagggactgacgcgttcccactttcttactctgcacctccccactctcttcccattcaagaacgagtttctcttccctctccattggaaatcctgctccggaggtccaaaacacgtattttaagcgtgcccttcctcacctcctggagcacccttagaagtattgcctacttatccgggctgagaatccttcatttttgacctggcttttttttcgccctttgggagataaaggtccctctccaccctctactaacactctgcacccaaggccttatcctttggggtcaccagctccttggccatttctatgtgatttcccccacccatctgagttccagtttcctctgggctccaatctccagtccctggcggatctggtcagtcccacccctaggtgggagtgaccagggggctctggcccaggattcccaaccctggaaggcagctccaaggcaggaagagaattgggcatcgggtacgaacctggcagctcaggagtcggggctccactcaccccacacaaaaagatgaaaaagcgcaaagagctcaatgcattgattggtttggctggggacagccggagaaagaagcccaagaaaggcccaagcagtcaccgcctgcttcgcactgagcctcccgactcagactctgagtccagctccgaagaggaagaggaattcggtgtggttggaaatcgctctcgctttgccaagggagactatttacgatgctgcaagatctgttatccgctctgtggttttgtcatccttgctgcctgtgttgtggcctgtgttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacaggatatcctgtaccttcacaactctttagaggaggtaaacagtgccctagtggggtaccagagacagaatgatcttaaactcgagggaatgaacgagacagtcagtaatcttacccagagagtcaacctgatagaaagcgatgtggttgctatgagcaaggtagaaaagaaagcaaacctgtccttcagcatgatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaatgccttccatccactctcaccccacacctttttttaatatatatacacccttacagattttctaacaaccaaataaaattctagcaataaattgaattatcgcctttcctgctttattagataaaccgccctataattgtaaattatgtccctg

SEQ ID NO: 361623 - DNA, 2463 bp, Homo sapiens
ggagtgcggcttactggcaggcggcgcaggcggccgctgccaaaggggaagtgatctggggctggagcgatggcccggggctggagctcgcggccgccgccgccgcagccgccgccaccaacgccaacaacaacgtgtcgggagcagccgcggccgaagccggagcaggggccggagtcgcggctggagtggggcctgcgcgtgtgagtggccgagagttgcccgtgccggagacctcaaactccgggcgggagcgctttcggtcggccgagccgccgtcgcccgcggcaccgtgtccccaaggcccagacagcggggcgggggtctatcaggcgcgggactggcttctctcaggccgacccttctagccgggctccggatcttcctcggcctcgggcccccttcacgttcaggacggaggccggagaacggtgatcatcacacaccccagccggcttcctggccagggcattttctctgcggccaagcagtgttgggattgtagctgctgggagccccctcctgccgccacctctcctgcaaggaagggactgacgcgttcccactttcttactctgcacctccccactctcttcccattcaagaacgagtttctcttccctctccattggaaatcctgctccggaggtccaaaacacgtattttaagcgtgcccttcctcacctcctggagcacccttagaagtattgcctacttatccgggctgagaatccttcatttttgacctggcttttttttcgccctttgggagataaaggtccctctccaccctctactaacactctgcacccaaggccttatcctttggggtcaccagctccttggccatttctatgtgatttcccccacccatctgagttccagtttcctctgggctccaatctccagtccctggcggatctggtcagtcccacccctaggtgggagtgaccagggggctctggcccaggattcccaaccctggaaggcagctccaaggcaggaagagaattgggcatcgggtacgaacctggcagctcaggagtcggggctccactcaccccacacaaaaagatgaaaaagcgcaaagagctcaatgcattgattggtttggctggggacagccggagaaagaagcccaagaaaggcccaagcagtcaccgcctgcttcgcactgagcctcccgactcagactctgagtccagctccgaagaggaagaggaattcggtgtggttggaaatcgctctcgctttgccaagggagactatttacgatgctgcaagatctgttatccgctctgtggttttgtcatccttgctgcctgtgttgtggcctgtgttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacaggatatcctgtaccttcacaactctttagaggaggtaaacagtgccctagtggggtaccagagacagaatgatcttaaactcgagggaatgaacgagacagtcagtaatcttacccagagagtcaacctgatagaaagcgatgtggttgctatgagcaaggtagaaaagaaagcaaacctgtccttcagcatgatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaaggtaaatttttataccacggggtagtaatgggaatgttcaaagtaataactttttaatgttattttcacttgtcaaaa

SEQ ID NO: 361624 - DNA, 1749 bp, Homo sapiens
ggagtgcggcttactggcaggcggcgcaggcggccgctgccaaaggggaagtgatctggggctggagcgatggcccggggctggagctcgcggccgccgccgccgcagccgccgccaccaacgccaacaacaacgtgtcgggagcagccgcggccgaagccggagcaggggccggagtcgcggctggagtggggcctgcgcgtgtgagtggccgagagttgcccgtgccggagacctcaaactccgggcgggagcgctttcggtcggccgagccgccgtcgcccgcggcaccgtgtccccaaggcccagacagcggggcgggggtctatcaggcgcgggactggcttctctcaggccgacccttctagccgggctccggatcttcctcggcctcgggcccccttcacgttcaggacggaggccggagaacggtgatcatcacacaccccagccggcttcctggccagggcattttctctgcggccaagcagtgttgggattgtagctgctgggagccccctcctgccgccacctctcctgcaaggaagggactgacgcgttcccactttcttactctgcacctccccactctcttcccattcaagaacgagtttctcttccctctccattggaaatcctgctccggaggtccaaaacacgtattttaagcgtgcccttcctcacctcctggagcacccttagaagtattgcctacttatccgggctgagaatccttcatttttgacctggcttttttttcgccctttgggagataaaggtccctctccaccctctactaacactctgcacccaaggccttatcctttggggtcaccagctccttggccatttctatgtgatttcccccacccatctgagttccagtttcctctgggctccaatctccagtccctggcggatctggtcagtcccacccctaggtgggagtgaccagggggctctggcccaggattcccaaccctggaaggcagctccaaggcaggaagagaattgggcatcgggtacgaacctggcagctcaggagtcggggctccactcaccccacacaaaaagatgaaaaagcgcaaagagctcaatgcattgattggtttggctggggacagccggagaaagaagcccaagaaaggcccaagcagtcaccgcctgcttcgcactgagcctcccgactcagactctgagtccagctccgaagaggaagaggaattcggtgtggttggaaatcgctctcgctttgccaagtgagtagtggtgaaaggtggaatgggaagaaggcatctccttgcactaccaaggggccacattgacaggaaggagaaaggaagtccttaggaagaaaaaagggtgtaggccttggaagtcaaagagggaaaaacggttttagggagaaggtaagttcagatcctgaatgaagaataagttagagatctgtctttaggtgtagaaagaaaagctccaaatctgaggtggaaatgtggacttggagaatgtgccaagagcccagggagtcctaaagaagcaaagaatggagacagaggagcagagaagctttggggactagactttttaaaacagtgtagaacaaaggagaagcagagactttaagactgcagattatttcgtttttgcactcttgatgagtctgaatattggtggtggggaaatatggtgagagatatactgtaggaagtatgagccttgagagtaggtggggtcggggggcaaaagaag

SEQ ID NO: 361625 - DNA, 475 bp, Homo sapiens
cttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttccctcggcagcctgatcttattttttaaaaacaaaaacagaaaaaaaaaaccactgtctgtggtctaggtattctacagaatccaaaagttgtccaagtgtgataggaatgctcaattgaaaccaatgaaggacttctatctgccctaggatataatggaaagttctattaaaattagtagaccatttaaaaacacctgataactctgtatttgacaaaaagcccccactgcaagtactgacacattcctatcaaatagttaggatttactaatttatgaggcag

SEQ ID NO: 361626 - DNA, 1244 bp, Homo sapiens
cttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcatcgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggtaa

SEQ ID NO: 361627 - DNA, 1546 bp, Homo sapiens
  misc_feature (1253)..(1253): n is a, c, g, or t
cttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcatcgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggtaaaaaaaaaanaaaatgagactgagttctatattctggggagttaatggggttgcctcccagcttcttataagactcacagtataactaaacatgatatatcagcttttgcctttcaatttatcaatctcttaaagagaatccaactctattacgatttgtatatgatcaaacttccatatttgccttgggaataatggacaaagggaaatactcttaattccatgaataaaaactttgcagaaaaattaacagtggttaattttcgaaaacttccctttttagacagtagataccacccactt

SEQ ID NO: 361628 - DNA, 1420 bp, Homo sapiens
cttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcatcgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggtaaaatagctttatcctctgtcagaacacaaacaaacaaactttgagaggggaggaaggaaaccgtctagctcagggctcacttaggagagggatgagattagaaagttcaacacactgcttgtgcagcggagataaagtcaagaccctagcacccacttataaatatctcgttatatt

SEQ ID NO: 361629 - DNA, 1563 bp, Homo sapiens
cttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcatcgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggtaaaaaaaaacaaacaaaacagcgaagacatcgactcagatgaacggacacgaaaaacacacggagggcactactcgcgggggcggcgaacagaagatgaaaccgagaggccagcgctcaatggatcgtgcacccgaccagttggtaaggacagtaaacaggggcccccccaaagaggggcttgtaaagcaagcaggggacgcttcgagagtagcacaacgccaccgacaagatcacagccgaggacccatgcgagccacgcatcacagcagtacacaacgagagcacaaaccaagaagccaaacacagtcagcctgtctca

SEQ ID NO: 361630 - DNA, 1155 bp, Homo sapiens
cttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcatcgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgctgtcacctctcccacgggacctggggctttcgtccacagcttcctgtccccatctgtcggcctaccaccacccacaagattatttttcacccaaacctcaaataaatcccctgcgtttttggtaa

SEQ ID NO: 361631 - DNA, 2080 bp, Homo sapiens
cttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcatcgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgaggtgatctggccccgcccccacccggaacgggcctaaatccctagatggccctgcccttcatttcgcgtccttcggttgcctgggaaggacgagctcagggcggagcgcagcccaccccggccctcccgccgctccacccagcaccggagggtaggggcggcccagcttcagggagccctgattgggtgtacgcagggaaagcctcctgctattggctgcgatctccctcccctttctccgcagatgactgtcatggtgctgagcgtacagctacagcgcagggcactccgccggaaatgcgagccgcacgtgccgggcgctggggattcgagccccgggcccagcctgatcgctgacggcggcggcgggcacagcggcagtctgtggggtggctggggcatggcgggtgcctgccccaactggggagacaaggcaccgcagggcaagctgcccatggccctggggctctggccgctgtgggttcaagacgaggaccagcctgacactggaagtgcgggcgcagaattagaggaggcacaattagaggctgaggcagagggggaagacagatgagcctccaaaataaaggaccctgggcttgcttccgaccttactccttctcagcctctacccccacttgtagcagctattcccgcctcatcagccagccctgcggcagttcccgtcgagccccgcccttttctacctatccccttctccagccccttcccgcccaattcacggccccacccctgacctttctcgcccgggtgggcatcacccccgtctcgccagcaccccttcgacttctctgacctcatctcctttctctatagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggtaa

SEQ ID NO: 361632 - DNA, 2602 bp, Homo sapiens
cttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtcctcggcagcctgatcttctgcttcggcatctggatcctcatcgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagatgactgtcatggtgctgagcgtacagctacagcgcagggcactccgccggaaatgcgagccgcacgtgccgggcgctggggattcgagccccgggcccagcctgatcgctgacggcggcggcgggcacagcggcagtctgtggggtggctggggcatggcgggtgcctgccccaactggggagacaaggcaccgcagggcaagctgcccatggccctggggctctggccgctgtgggttcaagacgaggaccagcctgacactggaagtgcgggcgcagaattagaggaggcacaattagaggctgaggcagagggggaagacagatgagcctccaaaataaaggaccctgggcttgcttccgaccttactccttctcagcctctacccccacttgtagcagctattcccgcctcatcagccagccctgcggcagttcccgtcgagccccgcccttttctacctatccccttctccagccccttcccgcccaattcacggccccacccctgacctttctcgcccgggtgggcatcacccccgtctcgccagcaccccttcgacttctctgacctcatctcctttctctatagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggtaaaatagctttatcctctgtcagaacacaaacaaacaaactttgagaggggaggaaggaaaccgtctagctcagggctcacttaggagagggatgagattagaaagttcaacacactgcttgtgcagcggagataaagtcaagaccctagcacccacttataaatatctcgttatattaaaaaaaaaaaaaatgtccagggcccacctggctctgctcctgcacagaaagggttcatcttcactttgtgatctcacaggtcatggagtgagggtggtagagaggggcagaaatttcagggggaggggtggctgggaaaaagtaaaggggacaagccaatgtgtaactagcgctctccaagacatgcagaggagtgggggtggcctgtcaggggctgaaaagaaaagccagtgctgtacctggggggttgtctcactcctgtccccacaatccctgatactccggagtgatctgtcctttcagacacccactgtgaggtcccaatatcggggtttatcctttcctcagtcccagcctgttcagctctccaaccaagttttgggggcccctctaatgggggggatggccccagttgcttaggcctctgaggtcaacccctttacatcacagccctctccccaaataagaagcatgaggtgagctggaggaccctccctgggaggagggtgttctggggggtgagccagttttggggtcccccttcagtccctgaccaggcggtaaatgtgatgctgggccccacgctcgctggtggagactcgaagacataggcggtgcagag

SEQ ID NO: 361633 - DNA, 157 bp, Homo sapiens
tcatcgacaagaccagcttcgtgtcctttgtgggtgaggggggctggggcaggtgggagggcctcccccaacccaagcaacttcctggggtctcccttgtctcagggagacctacggtgccctactctgcaggcaggctacaggctcccatccactg

SEQ ID NO: 361634 - DNA, 2043 bp, Homo sapiens
cttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcatcgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggtaaaatagctttatcctctgtcagaacacaaacaaacaaactttgagaggggaggaaggaaaccgtctagctcagggctcacttaggagagggatgagattagaaagttcaacacactgcttgtgcagcggagataaagtcaagaccctagcacccacttataaatatctcgttatattaaaaaaaaaaaaaatgtccagggcccacctggctctgctcctgcacagaaagggttcatcttcactttgtgatctcacaggtcatggagtgagggtggtagagaggggcagaaatttcagggggaggggtggctgggaaaaagtaaaggggacaagccaatgtgtaactagcgctctccaagacatgcagaggagtgggggtggcctgtcaggggctgaaaagaaaagccagtgctgtacctggggggttgtctcactcctgtccccacaatccctgatactccggagtgatctgtcctttcagacacccactgtgaggtcccaatatcggggtttatcctttcctcagtcccagcctgttcagctctccaaccaagttttgggggcccctctaatgggggggatggccccagttgcttaggcctctgaggtcaacccctttacatcacagccctctccccaaataagaagcatgaggtgagctggaggaccctccctgggaggagggtgttctggggggtgagccagttttggggtcccccttcagtccctgaccaggcggtaaatgtgatgctgggccccacgctcgctggtggagactcgaagacataggcggtgcagag

SEQ ID NO: 361635 - DNA, 1738 bp, Homo sapiens
cttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcatcgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggtaaaatagctttatcctctgtcagaacacaaacaaacaaactttgagaggggaggaaggaaaccgtctagctcagggctcacttaggagagggatgagattagaaagttcaacacactgcttgtgcagcggagataaagtcaagaccctagcacccacttataaatatctcgttatattaaaaaaaaaaaaaatgtccagggcccacctggctctgctcctgcacagaaagggttcatcttcactttgtgatctcacaggtcatggagtgagggtggtagagaggggcagaaatttcagggggaggggtggctgggaaaaagtaaaggggacaagccaatgtgtaactagcgctctccaagacatgtgttccaggctctcatactggctgctcactccgtagaagccaccactgctgatgctgccaccggcccctgcctcctcaccacttgggccccagttcaggtccgcccagaacttgaccaggaagaaggcatg

SEQ ID NO: 361636 - DNA, 2879 bp, Homo sapiens
cttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcatcgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgaggtgatctggccccgcccccacccggaacgggcctaaatccctagatggccctgcccttcatttcgcgtccttcggttgcctgggaaggacgagctcagggcggagcgcagcccaccccggccctcccgccgctccacccagcaccggagggtaggggcggcccagcttcagggagccctgattgggtgtacgcagggaaagcctcctgctattggctgcgatctccctcccctttctccgcagatgactgtcatggtgctgagcgtacagctacagcgcagggcactccgccggaaatgcgagccgcacgtgccgggcgctggggattcgagccccgggcccagcctgatcgctgacggcggcggcgggcacagcggcagtctgtggggtggctggggcatggcgggtgcctgccccaactggggagacaaggcaccgcagggcaagctgcccatggccctggggctctggccgctgtgggttcaagacgaggaccagcctgacactggaagtgcgggcgcagaattagaggaggcacaattagaggctgaggcagagggggaagacagatgagcctccaaaataaaggaccctgggcttgcttccgaccttactccttctcagcctctacccccacttgtagcagctattcccgcctcatcagccagccctgcggcagttcccgtcgagccccgcccttttctacctatccccttctccagccccttcccgcccaattcacggccccacccctgacctttctcgcccgggtgggcatcacccccgtctcgccagcaccccttcgacttctctgacctcatctcctttctctatagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggtaaaatagctttatcctctgtcagaacacaaacaaacaaactttgagaggggaggaaggaaaccgtctagctcagggctcacttaggagagggatgagattagaaagttcaacacactgcttgtgcagcggagataaagtcaagaccctagcacccacttataaatatctcgttatattaaaaaaaaaaaaaatgtccagggcccacctggctctgctcctgcacagaaagggttcatcttcactttgtgatctcacaggtcatggagtgagggtggtagagaggggcagaaatttcagggggaggggtggctgggaaaaagtaaaggggacaagccaatgtgtaactagcgctctccaagacatgcagaggagtgggggtggcctgtcaggggctgaaaagaaaagccagtgctgtacctggggggttgtctcactcctgtccccacaatccctgatactccggagtgatctgtcctttcagacacccactgtgaggtcccaatatcggggtttatcctttcctcagtcccagcctgttcagctctccaaccaagttttgggggcccctctaatgggggggatggccccagttgcttaggcctctgaggtcaacccctttacatcacagccctctccccaaataagaagcatgaggtgagctggaggaccctccctgggaggagggtgttctggggggtgagccagttttggggtcccccttcagtccctgaccaggcggtaaatgtgatgctgggccccacgctcgctggtggagactcgaagacataggcggtgcagag

SEQ ID NO: 361637 - DNA, 1210 bp, Homo sapiens
cttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtcctcggcagcctgatcttctgcttcggcatctggatcctcatcgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggtaa

SEQ ID NO: 361638 - DNA, 1160 bp, Homo sapiens
cttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcatcgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggtaa

SEQ ID NO: 361639 - DNA, 2271 bp, Homo sapiens
tggaatacagatgtctagggaggggccaggcttggaaaaggtgaagcgagggtgcactagtaaggagactagagtgccctggtgactaggggagcgggtagatgcctgaagacggtgagggttggcctgaaaagaacgctgggcctgggcttgagagtcccagaaagaatccctttaacttttccctacaccccccagggctgcgcgcagggcctccagaagtggctgcacaacaaccttatttccatagtgggcatttgcctgggcgtcggcctactcgaggtgatctggccccgcccccacccggaacgggcctaaatccctagatggccctgcccttcatttcgcgtccttcggttgcctgggaaggacgagctcagggcggagcgcagcccaccccggccctcccgccgctccacccagcaccggagggtaggggcggcccagcttcagggagccctgattgggtgtacgcagggaaagcctcctgctattggctgcgatctccctcccctttctccgcagatgactgtcatggtgctgagcgtacagctacagcgcagggcactccgccggaaatgcgagccgcacgtgccgggcgctggggattcgagccccgggcccagcctgatcgctgacggcggcggcgggcacagcggcagtctgtggggtggctggggcatggcgggtgcctgccccaactggggagacaaggcaccgcagggcaagctgcccatggccctggggctctggccgctgtgggttcaagacgaggaccagcctgacactggaagtgcgggcgcagaattagaggaggcacaattagaggctgaggcagagggggaagacagatgagcctccaaaataaaggaccctgggcttgcttccgaccttactccttctcagcctctacccccacttgtagcagctattcccgcctcatcagccagccctgcggcagttcccgtcgagccccgcccttttctacctatccccttctccagccccttcccgcccaattcacggccccacccctgacctttctcgcccgggtgggcatcacccccgtctcgccagcaccccttcgacttctctgacctcatctcctttctctatagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggtaaaatagctttatcctctgtcagaacacaaacaaacaaactttgagaggggaggaaggaaaccgtctagctcagggctcacttaggagagggatgagattagaaagttcaacacactgcttgtgcagcggagataaagtcaagaccctagcacccacttataaatatctcgttatattaaaaaaaaaaaaaatgtccagggcccacctggctctgctcctgcacagaaagggttcatcttcactttgtgatctcacaggtcatggagtgagggtggtagagaggggcagaaatttcagggggaggggtggctgggaaaaagtaaaggggacaagccaatgtgtaactagcgctctccaagacatgcagaggagtgggggtggcctgtcaggggctgaaaagaaaagccagtgctgtacctggggggttgtctcactcctgtccccacaatccctgatactccggagtgatctgtcctttcagacacccactgtgaggtcccaatatcggggtttatcctttcctcagtcccagcctgttcagctctccaaccaagttttgggggcccctctaatgggggggatggccccagttgcttaggcctctgaggtcaacccctttacatcacagccctctccccaaataagaagcatgaggtgagctggaggaccctccctgggaggagggtgttctggggggtgagccagttttggggtcccccttcagtccctgaccaggcggtaaatgtgatgctgggccccacgctcgctggtggagactcgaagacataggcggtgcagag

SEQ ID NO: 361640 - DNA, 2262 bp, Homo sapiens
ggtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcagggctttgtggaatctatgaaaattattctgggtgggtccatggcccgggtaggagccctgagtgagtgtccattccaaggggacgagtccatccacagtgcagtgaccaatgcactgcactccattctaggggagcagaccaaggcgctggtcacccaactcaccctcttcaaccagatcctggtggagctgcgggatgatatacgagaccaggtgaaggaaatgtccctgatccgaaacaccattatggagtgtcaggtgtgcggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagtgctgattagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttctgcctatcagaccgtcgtcctgcctgagatgggatcctctagatcacctcc

SEQ ID NO: 361641 - DNA, 2369 bp, Homo sapiens
ggtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcagggctttgtggaatctatgaaaattattctgggtgggtccatggcccgggtaggagccctgagtgagtgtccattccaaggggacgagtccatccacagtgcagtgaccaatgcactgcactccattctaggggagcagaccaaggcgctggtcacccaactcaccctcttcaaccagatcctggtggagctgcgggatgatatacgagaccaggtgaaggaaatgtccctgatccgaaacaccattatggagtgtcaggtgtgcggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggtgcaggcctggggctgaaggggtggctgggggacctgtgagaatttggatcaggtggggatgaagcagggaagctaggaagtctctgtgaaatagggaggcaggcttgtggacgttggcctgggtgaggagagattacctgcagcagatgtcaataggaatgtgaggtagggcgtagtgttaggcagagtgtggactagagggtgagacaagaaacaggcagatttcctggccagttgtcctctgggtggggagacaaagttcgggactttcaccaactgctgattagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttctgcctatcagaccgtcgtcctgcctgagatgggatcctctagatcacctcc

SEQ ID NO: 361642 - DNA, 2305 bp, Homo sapiens
cccatccagaggtggcccacgtagcgggacagcgctgtcggcccggcgcgcctcggagtgtcacggcgcctcgtccaagtggagccccgaacccctgaaggcgcggcaggctctggagagcggggtcttgtgcgcctgggccagtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcagggctttgtggaatctatgaaaattattctgggtgggtccatggcccgggtaggagccctgagtgagtgtccattccaaggggacgagtccatccacagtgcagtgaccaatgcactgcactccattctaggggagcagaccaaggcgctggtcacccaactcaccctcttcaaccagatcctggtggagctgcgggatgatatacgagaccaggtgaaggaaatgtccctgatccgaaacaccattatggagtgtcaggtgtgcggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagtgctgattagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttctgcctatcagaccgtcgtcctgcctgagatgggatcctctagatcacctcc

SEQ ID NO: 361643 - DNA, 2125 bp, Homo sapiens
ggtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcagggctttgtggaatctatgaaaattattctgggtgggtccatggcccgggtaggagccctgagtgagtgtccattccaaggggacgagtccatccacagtgcagtgaccaatgcactgcactccattctaggggagcagaccaaggcgctggtcacccaactcaccctcttcaaccagatcctggtggagctgcgggatgatatacgagaccaggtgaaggaaatgtccctgatccgaaacaccattatggagtgtcaggtgtgcggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggcatccccaatggattggacaattgccctaaagtccccaacccactacagacagacagggatgaggacggggtgggagatgcttgcgacagctgccctgaaatgagcaatcctacccaggtacagggagatggtaaggacaggggagggatgagggtactgatggatgaagccccagccctttggatggaaagtggtcagatcaccctcttcagagttatcaagaggagatggtgagaacaggtccctctctctcagacagatgcagacagcgacctggtgggggatgtctgtgatactaatgaagacagcccactggcaagctgcttcttggaggtgctgaacagagacggagactcgctcgggaacccatgctggaggtcagtggcgcgttcc

SEQ ID NO: 361644 - DNA, 843 bp, Homo sapiens
ggtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcagggctttgtggaatctatgaaaattattctgggtgggtccatggcccgggtaggagccctgagtgagtgtccattccaaggggacgagtccatccacagtgcaggtaacacagagacttgtttgctgacattggaccacggatcctgtggcctttggtgactcctgtcttcttgatctccctctcccttaaaacccattcctttggctcacctgttcctagggtttctaaccctgttattccaaatctttcacctgactccacaatctccaatacaccc

SEQ ID NO: 361645 - DNA, 622 bp, Homo sapiens
ttttttttttctcagatacagattcatttggtgatgcctgtgacaacgacgtggatggggatggtgcaggcctggggctgaaggggtggctgggggacctgtgagaatttggatcaggtggggatgaagcagggaagctaggaatgtgaggtagggcgtagtgttaggcagagtgtggactagagggtgagacaagaaacaggcagatttcctggccagttgtcctctgggtggggagacaaagttcgggactttcaccaactgctgattagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttctgcctatcagaccgtcgtcctgcctgagatgggatcctctagatcacctcc

SEQ ID NO: 361646 - DNA, 703 bp, Homo sapiens
agacagggtttcatcgtgttggccaggctggtctcgaactcctgacctcaggtgatctgcccgccttggcctcccaaagtactgggaatacaggcatgagccactgtgcccaggccatagtatattctaaattccttctatgatttagccttaattctctattgctattcagcaggaatttattcttacagtcatccctccattcctactgccagaccttcacctcacctggctgactgccaggggtctgattgtatggagagcaggctccagagactcccaggcagaagcgaagggaaggacaaggagtacctttaaatcctttatttggtacctgttcttctgctgattagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttctgcctatcagaccgtcgtcctgcctgagatgggatcctctagatcacctcc

SEQ ID NO: 361647 - DNA, 399 bp, Homo sapiens
ttgtggacgttggcctgggtgaggagagattacctgcagcagatgtcaataggaatgtgaggtagggcgtagtgttaggcagagtgtggactagagggtgagacaagaaacaggcagatttcctggccagttgtcctctgggtggggagacaaagttcgggactttcaccaacctagaagagagaatatggcatgttctagtaacaaccttgtgctacccatgtcttctaggcatccccaatggattggacaattgccctaaagtccccaacccactacagacagacagggatgaggacggggtgggagatgcttgcgacagctgccctgaaatgagcaatcctacccaggtacagggagatggtaaggacaggggagggatgagggtactgatggatg

SEQ ID NO: 361648 - DNA, 2303 bp, Homo sapiens
ggtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcagggctttgtggaatctatgaaaattattctgggtgggtccatggcccgggtaggagccctgagtgagtgtccattccaaggggacgagtccatccacagtgcagtgaccaatgcactgcactccattctaggggagcagaccaaggcgctggtcacccaactcaccctcttcaaccagatcctggtggagctgcgggatgatatacgagaccaggtgaaggaaatgtccctgatccgaaacaccattatggagtgtcaggtgtgcggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagtgctgattagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatgtggccagggccttcctgagcacccagcctcactctgcccaggcaatggcgttggtgatgtgtgtgaggatgactttgacaatgatgctgtggtcgaccccctggatgtgtgtcctgaaagtgcagaggtaacgcttacggattttctgcctatcagaccgtcgtcctgcctgagatgggatcctctagatcacctcc

SEQ ID NO: 361649 - DNA, 1967 bp, Homo sapiens
ggtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcagggctttgtggaatctatgaaaattattctgggtgggtccatggcccgggtaggagccctgagtgagtgtccattccaaggggacgagtccatccacagtgcagtgaccaatgcactgcactccattctaggggagcagaccaaggcgctggtcacccaactcaccctcttcaaccagatcctggtggagctgcgggatgatatacgagaccaggtgaaggaaatgtccctgatccgaaacaccattatggagtgtcaggtgtgcggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagaatgctgtttgtctccccgtccagggtagagccaggcaaggtccagcccatcaaagccatgggtg

SEQ ID NO: 361650 - DNA, 2143 bp, Homo sapiens
ggtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcagggctttgtggaatctatgaaaattattctgggtgggtccatggcccgggtaggagccctgagtgagtgtccattccaaggggacgagtccatccacagtgcagtgaccaatgcactgcactccattctaggggagcagaccaaggcgctggtcacccaactcaccctcttcaaccagatcctggtggagctgcgggatgatatacgagaccaggtgaaggaaatgtccctgatccgaaacaccattatggagtgtcaggtgtgcggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagtgctgattagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatgtggccagggccttcctgagcacccagcctcactctgcccaggcaatggcgttggtgatgtgtgtgaggatgactttgacaatgatgctgtggtcgaccccctggatgtgtgtcctgaaagtgcagaggtaacgcttacggattttctgcctatcagaccgtcgtcctgcctgagatgggatcctctagatcacctcc

SEQ ID NO: 361651 - DNA, 350 bp, Homo sapiens
ctgtttcccgggctccagctgcatcaacaccatgcccggcttccactgtgaggcctgtcctcgagggtacaagggcacacaggtgtctggtgtgggcattgactatgcccgggccagcaaacaggtcagactgggtagtgtgtgtggacaagggatcttggccttgtagaggccaggggcttctgggttggacatgggacccttgtgatgaatgggacatggatggctttgcatcggctttgggtctgggcttaatgttgatgttcacagataaggccataccagtgtcctctgctgtatctgaggagacccaccataggtctggttccacccaaagtctgccccttcag

SEQ ID NO: 361652 - DNA, 1253 bp, Homo sapiens
  misc_feature (11)..(11): n is a, c, g, or t
  misc_feature (13)..(13): n is a, c, g, or t
  misc_feature (21)..(21): n is a, c, g, or t
  misc_feature (42)..(42): n is a, c, g, or t
ccgggagaaantnaaaaaagnacataggctaggtgcgaggcngggtggtgtggtcagaagggaggtggccggtctccgtcgtgacctctgacggtttctgagcgttggcctttggcacgcgctacccccttttgctttggttctgccatgccgatgtaccaggtaaagccctatcacgggggcggcgcgcctctccgtgtggagcttcccacctgcatgtaccggctccccaacgtgcacggcaggagctacggcccagcgccgggcgctggccacgtgcaggaagagtctaacctgtctctgcaagctcttgagtcccgccaagatgatattttaaaacgtctgtatgagttgaaagctgcagttgatggcctctccaagatgattcaaacaccagatgcagacttggatgtaaccaacataatccaagcggatgagcccacgactttaaccaccaatgcgctggacttgaattcagtgcttgggaaggattacggggcgctgaaagacatcgtgatcaacgcaaacccggcctcccctcccctctccctgcttgtgctgcacaggctgctctgtgagcacttcagggtcctgtccacggtgcacacgcactcctcggtcaagagcgtgcctgaaaaccttctcaagtgctttggagaacagaataaaaaacagccccgccaagactatcagctgggattcactttaatttggaagaatgtgccgaagacgcagatgaaattcagcatccagacgatgtgccccatcgaaggcgaagggaacattgcacgtttcttgttctctctgtttggccagaagcataatgctgtcaacgcaacccttatagatagctgggtagatattgcgatttttcagttaaaagagggaagcagtaaagaaaaagccgctgttttccgctccatgaactctgctcttgggaagagcccttggctcgctgggaatgaactcaccgtagcagacgtggtgctgtggtctgtactccagcagatcggaggctgcagtgtgacagtgccagccaatgtgcagaggtggatgaggtcttgtgaaaacctggctccttttaacacggccctcaagctccttaagtgaattgccgtaactgattttaaagggtttagattttaagaatggtgctctttcatgcctattatcagtaaggggacttgtattagagtcagagtctttttatttaggccagttgtcaagtgtcaataaaagcatcatgtaattta

SEQ ID NO: 361653 - DNA, 1133 bp, Homo sapiens
  misc_feature (11)..(11): n is a, c, g, or t
  misc_feature (13)..(13): n is a, c, g, or t
  misc_feature (21)..(21): n is a, c, g, or t
  misc_feature (42)..(42): n is a, c, g, or t
ccgggagaaantnaaaaaagnacataggctaggtgcgaggcngggtggtgtggtcagaagggaggtggccggtctccgtcgtgacctctgacggtttctgagcgttggcctttggcacgcgctacccccttttgctttggttctgccatgccgatgtaccaggaagagtctaacctgtctctgcaagctcttgagtcccgccaagatgatattttaaaacgtctgtatgagttgaaagctgcagttgatggcctctccaagatgattcaaacaccagatgcagacttggatgtaaccaacataatccaagcggatgagcccacgactttaaccaccaatgcgctggacttgaattcagtgcttgggaaggattacggggcgctgaaagacatcgtgatcaacgcaaacccggcctcccctcccctctccctgcttgtgctgcacaggctgctctgtgagcacttcagggtcctgtccacggtgcacacgcactcctcggtcaagagcgtgcctgaaaaccttctcaagtgctttggagaacagaataaaaaacagccccgccaagactatcagctgggattcactttaatttggaagaatgtgccgaagacgcagatgaaattcagcatccagacgatgtgccccatcgaaggcgaagggaacattgcacgtttcttgttctctctgtttggccagaagcataatgctgtcaacgcaacccttatagatagctgggtagatattgcgatttttcagttaaaagagggaagcagtaaagaaaaagccgctgttttccgctccatgaactctgctcttgggaagagcccttggctcgctgggaatgaactcaccgtagcagacgtggtgctgtggtctgtactccagcagatcggaggctgcagtgtgacagtgccagccaatgtgcagaggtggatgaggtcttgtgaaaacctggctccttttaacacggccctcaagctccttaagtgaattgccgtaactgattttaaagggtttagattttaagaatggtgctctttcatgcctattatcagtaaggggacttgtattagagtcagagtctttttatttaggccagttgtcaagtgtcaataaaagcatcatgtaattta

SEQ ID NO: 361654 - DNA, 1284 bp, Homo sapiens
  misc_feature (11)..(11): n is a, c, g, or t
  misc_feature (13)..(13): n is a, c, g, or t
  misc_feature (21)..(21): n is a, c, g, or t
  misc_feature (42)..(42): n is a, c, g, or t
ccgggagaaantnaaaaaagnacataggctaggtgcgaggcngggtggtgtggtcagaagggaggtggccggtctccgtcgtgacctctgacggtttctgagcgttggcctttggcacgcgctacccccttttgctttggttctgccatgccgatgtaccagtagagacggggtttcaccatgttggccaggctggtcttgaactcctgacgtcagatgatctgcctacctggacctcccgaagtgctgggattacaggcgtgagccaccacacccagcccataatgtcttcttttaaagggtgggaggtttggaagagtctaacctgtctctgcaagctcttgagtcccgccaagatgatattttaaaacgtctgtatgagttgaaagctgcagttgatggcctctccaagatgattcaaacaccagatgcagacttggatgtaaccaacataatccaagcggatgagcccacgactttaaccaccaatgcgctggacttgaattcagtgcttgggaaggattacggggcgctgaaagacatcgtgatcaacgcaaacccggcctcccctcccctctccctgcttgtgctgcacaggctgctctgtgagcacttcagggtcctgtccacggtgcacacgcactcctcggtcaagagcgtgcctgaaaaccttctcaagtgctttggagaacagaataaaaaacagccccgccaagactatcagctgggattcactttaatttggaagaatgtgccgaagacgcagatgaaattcagcatccagacgatgtgccccatcgaaggcgaagggaacattgcacgtttcttgttctctctgtttggccagaagcataatgctgtcaacgcaacccttatagatagctgggtagatattgcgatttttcagttaaaagagggaagcagtaaagaaaaagccgctgttttccgctccatgaactctgctcttgggaagagcccttggctcgctgggaatgaactcaccgtagcagacgtggtgctgtggtctgtactccagcagatcggaggctgcagtgtgacagtgccagccaatgtgcagaggtggatgaggtcttgtgaaaacctggctccttttaacacggccctcaagctccttaagtgaattgccgtaactgattttaaagggtttagattttaagaatggtgctctttcatgcctattatcagtaaggggacttgtattagagtcagagtctttttatttaggccagttgtcaagtgtcaataaaagcatcatgtaattta

SEQ ID NO: 361655 - DNA, 1012 bp, Homo sapiens
gagccaccgtgcccggcccctaaacaatagtcttcatataggaagagtctaacctgtctctgcaagctcttgagtcccgccaagatgatattttaaaacgtctgtatgagttgaaagctgcagttgatggcctctccaagatgattcaaacaccagatgcagacttggatgtaaccaacataatccaagcggatgagcccacgactttaaccaccaatgcgctggacttgaattcagtgcttgggaaggattacggggcgctgaaagacatcgtgatcaacgcaaacccggcctcccctcccctctccctgcttgtgctgcacaggctgctctgtgagcacttcagggtcctgtccacggtgcacacgcactcctcggtcaagagcgtgcctgaaaaccttctcaagtgctttggagaacagaataaaaaacagccccgccaagactatcagctgggattcactttaatttggaagaatgtgccgaagacgcagatgaaattcagcatccagacgatgtgccccatcgaaggcgaagggaacattgcacgtttcttgttctctctgtttggccagaagcataatgctgtcaacgcaacccttatagatagctgggtagatattgcgatttttcagttaaaagagggaagcagtaaagaaaaagccgctgttttccgctccatgaactctgctcttgggaagagcccttggctcgctgggaatgaactcaccgtagcagacgtggtgctgtggtctgtactccagcagatcggaggctgcagtgtgacagtgccagccaatgtgcagaggtggatgaggtcttgtgaaaacctggctccttttaacacggccctcaagctccttaagtgaattgccgtaactgattttaaagggtttagattttaagaatggtgctctttcatgcctattatcagtaaggggacttgtattagagtcagagtctttttatttaggccagttgtcaagtgtcaataaaagcatcatgtaattta

SEQ ID NO: 361656 - DNA, 1255 bp, Homo sapiens
gctccctccccccccccccccccccctacgctagtaggccggtgatcggacgaggtcagaagggaggtggccggtctccgtcgtgacctctgacggtttctgagcgttggcctttggcacgcgctacccccttttgctttggttctgccatgccgatgtaccaggtaaagccctatcacgggggcggcgcgcctctccgtgtggagcttcccacctgcatgtaccggctccccaacgtgcacggcaggagctacggcccagcgccgggcgctggccacgtgcaggaagagtctaacctgtctctgcaagctcttgagtcccgccaagatgatattttaaaacgtctgtatgagttgaaagctgcagttgatggcctctccaagatgattcaaacaccagatgcagacttggatgtaaccaacataatccaagcggatgagcccacgactttaaccaccaatgcgctggacttgaattcagtgcttgggaaggattacggggcgctgaaagacatcgtgatcaacgcaaacccggcctcccctcccctctccctgcttgtgctgcacaggctgctctgtgagcacttcagggtcctgtccacggtgcacacgcactcctcggtcaagagcgtgcctgaaaaccttctcaagtgctttggagaacagaataaaaaacagccccgccaagactatcagctgggattcactttaatttggaagaatgtgccgaagacgcagatgaaattcagcatccagacgatgtgccccatcgaaggcgaagggaacattgcacgtttcttgttctctctgtttggccagaagcataatgctgtcaacgcaacccttatagatagctgggtagatattgcgatttttcagttaaaagagggaagcagtaaagaaaaagccgctgttttccgctccatgaactctgctcttgggaagagcccttggctcgctgggaatgaactcaccgtagcagacgtggtgctgtggtctgtactccagcagatcggaggctgcagtgtgacagtgccagccaatgtgcagaggtggatgaggtcttgtgaaaacctggctccttttaacacggccctcaagctccttaagtgaattgccgtaactgattttaaagggtttagattttaagaatggtgctctttcatgcctattatcagtaaggggacttgtattagagtcagagtctttttatttaggccagttgtcaagtgtcaataaaagcatcatgtaattta

SEQ ID NO: 361657 - DNA, 1046 bp, Homo sapiens
  misc_feature (11)..(11): n is a, c, g, or t
  misc_feature (13)..(13): n is a, c, g, or t
  misc_feature (21)..(21): n is a, c, g, or t
  misc_feature (42)..(42): n is a, c, g, or t
ccgggagaaantnaaaaaagnacataggctaggtgcgaggcngggtggtgtggtcagaagggaggtggccggtctccgtcgtgacctctgacggtttctgagcgttggcctttggcacgcgctacccccttttgctttggttctgccatgccgatgtaccaggtaaagccctatcacgggggcggcgcgcctctccgtgtggagcttcccacctgcatgtaccggctccccaacgtgcacggcaggagctacggcccagcgccgggcgctggccacgtgcaggattacggggcgctgaaagacatcgtgatcaacgcaaacccggcctcccctcccctctccctgcttgtgctgcacaggctgctctgtgagcacttcagggtcctgtccacggtgcacacgcactcctcggtcaagagcgtgcctgaaaaccttctcaagtgctttggagaacagaataaaaaacagccccgccaagactatcagctgggattcactttaatttggaagaatgtgccgaagacgcagatgaaattcagcatccagacgatgtgccccatcgaaggcgaagggaacattgcacgtttcttgttctctctgtttggccagaagcataatgctgtcaacgcaacccttatagatagctgggtagatattgcgatttttcagttaaaagagggaagcagtaaagaaaaagccgctgttttccgctccatgaactctgctcttgggaagagcccttggctcgctgggaatgaactcaccgtagcagacgtggtgctgtggtctgtactccagcagatcggaggctgcagtgtgacagtgccagccaatgtgcagaggtggatgaggtcttgtgaaaacctggctccttttaacacggccctcaagctccttaagtgaattgccgtaactgattttaaagggtttagattttaagaatggtgctctttcatgcctattatcagtaaggggacttgtattagagtcagagtctttttatttaggccagttgtcaagtgtcaataaaagcatcatgtaattta

SEQ ID NO: 361658 - DNA, 1339 bp, Homo sapiens
  misc_feature (11)..(11): n is a, c, g, or t
  misc_feature (13)..(13): n is a, c, g, or t
  misc_feature (21)..(21): n is a, c, g, or t
  misc_feature (42)..(42): n is a, c, g, or t
ccgggagaaantnaaaaaagnacataggctaggtgcgaggcngggtggtgtggtcagaagggaggtggccggtctccgtcgtgacctctgacggtttctgagcgttggcctttggcacgcgctacccccttttgctttggttctgccatgccgatgtaccaggtaaagccctatcacgggggcggcgcgcctctccgtgtggagcttcccacctgcatgtaccggctccccaacgtgcacggcaggagctacggcccagcgccgggcgctggccacgtgcagaaatggagtttcatcatgttgtcctctcgaactcctgacctcaagtgatccacccgcctcgcccttccaaagtgctgagattacaggaagagtctaacctgtctctgcaagctcttgagtcccgccaagatgatattttaaaacgtctgtatgagttgaaagctgcagttgatggcctctccaagatgattcaaacaccagatgcagacttggatgtaaccaacataatccaagcggatgagcccacgactttaaccaccaatgcgctggacttgaattcagtgcttgggaaggattacggggcgctgaaagacatcgtgatcaacgcaaacccggcctcccctcccctctccctgcttgtgctgcacaggctgctctgtgagcacttcagggtcctgtccacggtgcacacgcactcctcggtcaagagcgtgcctgaaaaccttctcaagtgctttggagaacagaataaaaaacagccccgccaagactatcagctgggattcactttaatttggaagaatgtgccgaagacgcagatgaaattcagcatccagacgatgtgccccatcgaaggcgaagggaacattgcacgtttcttgttctctctgtttggccagaagcataatgctgtcaacgcaacccttatagatagctgggtagatattgcgatttttcagttaaaagagggaagcagtaaagaaaaagccgctgttttccgctccatgaactctgctcttgggaagagcccttggctcgctgggaatgaactcaccgtagcagacgtggtgctgtggtctgtactccagcagatcggaggctgcagtgtgacagtgccagccaatgtgcagaggtggatgaggtcttgtgaaaacctggctccttttaacacggccctcaagctccttaagtgaattgccgtaactgattttaaagggtttagattttaagaatggtgctctttcatgcctattatcagtaaggggacttgtattagagtcagagtctttttatttaggccagttgtcaagtgtcaataaaagcatcatgtaattta

SEQ ID NO: 361659 - DNA, 1930 bp, Homo sapiens
ttcgatgagccgggacgtggcgccgctctagccagcgcctgggctctgtggcgggcgccgcagctccgcgtcccccgcgcctcctcccagcgcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagagctggagctggtgcagaatgccttcttcactgaccccaatgaccagagtgcctggttttatcaccgttggctcctaggccgagctgacccccaggatgcactgcgctgcctgcatgtgagccgggacgaggcctgtctgactgtctccttctctcggcccctcttagtgggctccaggatggagatcttgctgctcatggttgatgattctcccctgattgtggagtggaggaccccagatggcaggaaccggcccagccatgtctggctctgtgacctgcctgctgcctccctcaacgaccagttgccccaacatacatttcgcgtcatttggacagcaggcgatgtccagaaagaatgcgtgcttttaaaaggccgccaggagggctggtgccgggactccacgacagacgagcagctattcaggtgtgagctgtcagtggagaagtccacagtgctgcagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggtgctgcaggccagtgataatgccatagagtccctggacggcgtcaccaacctaccccggctgcaggagctgctactgtgcaacaaccgcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctaccaa

SEQ ID NO: 361660 - DNA, 710 bp, Homo sapiens
ttcgatgagccgggacgtggcgccgctctagccagcgcctgggctctgtggcgggcgccgcagctccgcgtcccccgcgcctcctcccagcgcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactctgcacccccagccggattctggaccacaggggcgcctccctgaggatgtgctgctcaaaggtttattgagcacctacttcatgcgtggctccaggggtgcttaagaatcagtccctggctgaaggaagcttaa

SEQ ID NO: 361661 - DNA, 2009 bp, Homo sapiens
ttcgatgagccgggacgtggcgccgctctagccagcgcctgggctctgtggcgggcgccgcagctccgcgtcccccgcgcctcctcccagcgcaggcacgcttgctgcttccggacacagctgtgggcggagctagtaggggcggggctacgtgattgacacttctctcctcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagagctggagctggtgcagaatgccttcttcactgaccccaatgaccagagtgcctggttttatcaccgttggctcctaggccgagctgacccccaggatgcactgcgctgcctgcatgtgagccgggacgaggcctgtctgactgtctccttctctcggcccctcttagtgggctccaggatggagatcttgctgctcatggttgatgattctcccctgattgtggagtggaggaccccagatggcaggaaccggcccagccatgtctggctctgtgacctgcctgctgcctccctcaacgaccagttgccccaacatacatttcgcgtcatttggacagcaggcgatgtccagaaagaatgcgtgcttttaaaaggccgccaggagggctggtgccgggactccacgacagacgagcagctattcaggtgtgagctgtcagtggagaagtccacagtgctgcagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggtgctgcaggccagtgataatgccatagagtccctggacggcgtcaccaacctaccccggctgcaggagctgctactgtgcaacaaccgcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctaccaa

SEQ ID NO: 361662 - DNA, 2417 bp, Homo sapiens
ttcgatgagccgggacgtggcgccgctctagccagcgcctgggctctgtggcgggcgccgcagctccgcgtcccccgcgcctcctcccagcgcaggtgggtccgcccgcggggggcgggggtgcccgggagccgtgggacgggcgggtagcggcaacctttggggagcagagtggtccccaacgcccaggtgccccggctcgcgctctggcccgggcgaatcgggctataggaagggccacacggatggaagtcctagtccgggtgctcacctcttgtggaacgtgcaaagcctgtcccaggacctctttacactctgggggtctctgcccaggcacgcttgctgcttccggacacagctgtgggcggagctagtaggggcggggctacgtgattgacacttctctcctcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagagctggagctggtgcagaatgccttcttcactgaccccaatgaccagagtgcctggttttatcaccgttggctcctaggccgagctgacccccaggatgcactgcgctgcctgcatgtgagccgggacgaggcctgtctgactgtctccttctctcggcccctcttagtgggctccaggatggagatcttgctgctcatggttgatgattctcccctgattgtggagtggaggaccccagatggcaggaaccggcccagccatgtctggctctgtgacctgcctgctgcctccctcaacgaccagttgccccaacatacatttcgcgtcatttggacagcaggcgatgtccagaaagaatgcgtgcttttaaaaggccgccaggagggctggtgccgggactccacgacagacgagcagctattcaggtggtgatagggaagcacaaaacaaggagaggggctctggactctgggcatcaggcagccagggcaggaggctggggcctcaaggagctgtttcagtctagatactgggaatgttgaccagtgcttcagggctgtgggcctcaactcctccccaccctgcccaccctcaggtgtgagctgtcagtggagaagtccacagtgctgcagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggtgctgcaggccagtgataatgccatagagtccctggacggcgtcaccaacctaccccggctgcaggagctgctactgtgcaacaaccgcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctaccaa

SEQ ID NO: 361663 - DNA, 2412 bp, Homo sapiens
ttcgatgagccgggacgtggcgccgctctagccagcgcctgggctctgtggcgggcgccgcagctccgcgtcccccgcgcctcctcccagcgcaggtgggtccgcccgcggggggcgggggtgcccgggagccgtgggacgggcgggtagcggcaacctttggggagcagagtggtccccaacgcccaggtgccccggctcgcgctctggcccgggcgaatcgggctataggaagggccacacggatggaagtcctagtccgggtgctcacctcttgtggaacgtgcaaagcctgtcccaggacctctttacactctgggggtctctgcccaggcacgcttgctgcttccggacacagctgtgggcggagctagtaggggcggggctacgtgattgacacttctctcctcagacttcaagggctaccactggacccttcccctgtcttgaaccctgagccggcaccatggtgagaaccctgagcccagcccttcacctccgcaggcccgcgccctcacccccagtggcagtgccatggttgccccgtatgaacctagggctccacagtgtggggtttttgcaggtcagcttctgcaaggcaacctgcactcttccaacccgttcatccttgtagcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagagctggagctggtgcagaatgccttcttcactgaccccaatgaccagagtgcctggttttatcaccgttggctcctaggccgagctgacccccaggatgcactgcgctgcctgcatgtgagccgggacgaggcctgtctgactgtctccttctctcggcccctcttagtgggctccaggatggagatcttgctgctcatggttgatgattctcccctgattgtggagtggaggaccccagatggcaggaaccggcccagccatgtctggctctgtgacctgcctgctgcctccctcaacgaccagttgccccaacatacatttcgcgtcatttggacagcaggcgatgtccagaaagaatgcgtgcttttaaaaggccgccaggagggctggtgccgggactccacgacagacgagcagctattcaggtgtgagctgtcagtggagaagtccacagtgctgcagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggtgctgcaggccagtgataatgccatagagtccctggacggcgtcaccaacctaccccggctgcaggagctgctactgtgcaacaaccgcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctaccaa

SEQ ID NO: 361664 - DNA, 1981 bp, Homo sapiens
ttcgatgagccgggacgtggcgccgctctagccagcgcctgggctctgtggcgggcgccgcagctccgcgtcccccgcgcctcctcccagcgcagacttcaagggctaccactggacccttcccctgtcttgaaccctgagccggcaccatggtcagcttctgcaaggcaacctgcactcttccaacccgttcatccttgtagcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagagctggagctggtgcagaatgccttcttcactgaccccaatgaccagagtgcctggttttatcaccgttggctcctaggccgagctgacccccaggatgcactgcgctgcctgcatgtgagccgggacgaggcctgtctgactgtctccttctctcggcccctcttagtgggctccaggatggagatcttgctgctcatggttgatgattctcccctgattgtggagtggaggaccccagatggcaggaaccggcccagccatgtctggctctgtgacctgcctgctgcctccctcaacgaccagttgccccaacatacatttcgcgtcatttggacagcaggcgatgtccagaaagaatgcgtgcttttaaaaggccgccaggagggctggtgccgggactccacgacagacgagcagctattcaggtgtgagctgtcagtggagaagtccacagtgctgcagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggtgctgcaggccagtgataatgccatagagtccctggacggcgtcaccaacctaccccggctgcaggagctgctactgtgcaacaaccgcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctaccaa

SEQ ID NO: 361665 - DNA, 2109 bp, Homo sapiens
ttcgatgagccgggacgtggcgccgctctagccagcgcctgggctctgtggcgggcgccgcagctccgcgtcccccgcgcctcctcccagcgcaggtgggtccgcccgcggggggcgggggtgcccgggagccgtgggacgggcgggtagcggcaacctttggggagcagagtggtccccaacgcccaggtgccccggctcgcgctctggcccgggcgaatcgggctataggaagggccacacggatggaagtcctagtccgggtgctcacctcttgtggaacgtgcaaagcctgtcccaggacctctttacactctgggggtctctgcccaggcacgcttgctgcttccggacacagctgtgggcggagctagtaggggcggggctacgtgattgacacttctctcctcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagagctggagctggtgcagaatgccttcttcactgaccccaatgaccagagtgcctggttttatcaccgttggctcctaggccgagctgacccccaggatgcactgcgctgcctgcatgtgagccgggacgaggcctgtctgactgtctccttctctcggcccctcttagtgggctccaggatggagatcttgctgctcatggttgatgattctcccctgattgtggagtggaggaccccagatggcaggaaccggcccagccatgtctggctctgtgacctgcctgctgcctccctcaacgaccagttgccccaacatacatttcgcgtcatttggacagcaggcgatgtccagaaagaatgcgtgcttttaaaaggccgccaggagggctggtgccgggactccacgacagacgagcagctattcaggtgtgagctgtcagtggagaagtccacagtgctgcagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggtaaagtacccatgtctccgtccctgtcacgggtggttcttttcctcttcctctccctcagaagtctgcccatcctacaaggagatgtgcaggaccctccaccccgaacaggtaactgcgtgccttccacctccatcacgcagcctgaccctgtgagcccctctgtgctctgtgga

SEQ ID NO: 361666 - DNA, 2350 bp, Homo sapiens
ttcgatgagccgggacgtggcgccgctctagccagcgcctgggctctgtggcgggcgccgcagctccgcgtcccccgcgcctcctcccagcgcaggtgggtccgcccgcggggggcgggggtgcccgggagccgtgggacgggcgggtagcggcaacctttggggagcagagtggtccccaacgcccaggtgccccggctcgcgctctggcccgggcgaatcgggctataggaagggccacacggatggaagtcctagtccgggtgctcacctcttgtggaacgtgcaaagcctgtcccaggacctctttacactctgggggtctctgcccaggcacgcttgctgcttccggacacagctgtgggcggagctagtaggggcggggctacgtgattgacacttctctcctcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagagctggagctggtgcagaatgccttcttcactgaccccaatgaccagagtgcctggttttatcaccgttggctcctaggccgagctgacccccaggatgcactgcgctgcctgcatgtgagccgggacgaggcctgtctgactgtctccttctctcggcccctcttagtgggctccaggatggagatcttgctgctcatggttgatgattctcccctgattgtggagtggaggaccccagatggcaggaaccggcccagccatgtctggctctgtgacctgcctgctgcctccctcaacgaccagttgccccaacatacatttcgcgtcatttggacagcaggcgatgtccagaaagaatgcgtgcttttaaaaggccgccaggagggctggtgccgggactccacgacagacgagcagctattcaggtgtgagctgtcagtggagaagtccacagtgctgcagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggccgtggaccccatgcgggcaacgtatctggatgacctgcgcagcaagttcttgctggagaatagcgtgctcaagatggagtatgccgaggtgcgtgtgctgcacctggctcacaaggtatgggctgccatgcatgccttcccctggccctcatcccgctggcctccccacgtccctgactttgcccccagtctcaggtgcctttgtggacttccaatcaagatagagttcatccctgcctcccagcttgctcctcttccaggcctttctgtcactcagcccattcttcttcttgccactcactttcaaatcccgagtcaccaggacctccttgtgctgtttcttccccaggctggtcacagcttcatcttccttcagagtgaccgctagcccactcctcccacacattccagcacatctcaccctggagcaacctccaatacctgaaggccaaatactttccagagattcctgagaagttgtccaggctccactttcctagtccttcccaacacattagttttatcacatcaccacagcccacctccattcctgccaaactcatctctgcctcatcaggaccagtccccatgggggaccagtctttgtttacccagcaccctaccactgcccctgtacctccgaact

SEQ ID NO: 361667 - DNA, 1731 bp, Homo sapiens
ttcgatgagccgggacgtggcgccgctctagccagcgcctgggctctgtggcgggcgccgcagctccgcgtcccccgcgcctcctcccagcgcaggtgggtccgcccgcggggggcgggggtgcccgggagccgtgggacgggcgggtagcggcaacctttggggagcagagtggtccccaacgcccaggtgccccggctcgcgctctggcccgggcgaatcgggctataggaagggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagagctggagctggtgcagaatgccttcttcactgaccccaatgaccagagtgcctggttttatcaccgttggctcctaggccgagctgacccccaggatgcactgcgctgcctgcatgtgagccgggacgaggcctgtctgactgtctccttctctcggcccctcttagtgggctccaggatggagatcttgctgctcatggttgatgattctcccctgattgtggagtggaggaccccagatggcaggaaccggcccagccatgtctggctctgtgacctgcctgctgcctccctcaacgaccagttgccccaacatacatttcgcgtcatttggacagcaggcgatgtccagaaagaatgcgtgcttttaaaaggccgccaggagggctggtgccgggactccacgacagacgagcagctattcaggtggtgatagggaagcacaaaacaaggagaggggctctggactctgggcatcaggcagccagggcaggaggctggggcctcaaggagctgtttcagtctagatactgggaatgttgaccagtgcttcagggctgtgggcctcaactcctccccaccctgcccaccctcaggtgtgagctgtcagtggagaagtccacagtgctgcagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggtgctgcaggccagtgataatgccatagagtccctggacggcgtcaccaacctaccccggctgcaggagctgctactgtgcaacaaccgcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctaccaa

SEQ ID NO: 361668 - DNA, 1170 bp, Homo sapiens
ttcgatgagccgggacgtggcgccgctctagccagcgcctgggctctgtggcgggcgccgcagctccgcgtcccccgcgcctcctcccagcgcaggtgggtccgcccgcggggggcgggggtgcccgggagccgtgggacgggcgggtagcggcaacctttggggagcagagtggtccccaacgcccaggtgccccggctcgcgctctggcccgggcgaatcgggctataggaagggccacacggatggaagtcctagtccgggtgctcacctcttgtggaacgtgcaaagcctgtcccaggacctctttacactctgggggtctctgcccaggcacgcttgctgcttccggacacagctgtgggcggagctagtaggggcggggctacgtgattgacacttctctcctcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaaggtttattgagcacctacttcatgcgtggctccaggggtgcttaagaatcagtccctggctgaaggaagcttaa

SEQ ID NO: 361669 - DNA, 1021 bp, Homo sapiens
ttcgatgagccgggacgtggcgccgctctagccagcgcctgggctctgtggcgggcgccgcagctccgcgtcccccgcgcctcctcccagcgcaggtgggtccgcccgcggggggcgggggtgcccgggagccgtgggacgggcgggtagcggcaacctttggggagcagagtggtccccaacgcccaggtgccccggctcgcgctctggcccgggcgaatcgggctataggaagggccacacggatggaagtcctagtccgggtgctcacctcttgtggaacgtgcaaagcctgtcccaggacctctttacactctgggggtctctgcccaggcacgcttgctgcttccggacacagctgtgggcggagctagtaggggcggggctacgtgattgacacttctctcctcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctaccaa

SEQ ID NO: 361670 - DNA, 570 bp, Homo sapiens
ttcgatgagccgggacgtggcgccgctctagccagcgcctgggctctgtggcgggcgccgcagctccgcgtcccccgcgcctcctcccagcgcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctaccaa

SEQ ID NO: 361671 - DNA, 374 bp, Homo sapiens
tcagttgctgaaccatccctggctgacagcgcctgtcctgcctccctgccctccctgcccgtgctgcaggccagtgataatgccatagagtccctggacggcgtcaccaacctaccccggctgcaggagctgctactgtgcaacaaccgcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctaccaa

SEQ ID NO: 361672 - DNA, 2247 bp, Homo sapiens
ttcgatgagccgggacgtggcgccgctctagccagcgcctgggctctgtggcgggcgccgcagctccgcgtcccccgcgcctcctcccagcgcaggtgggtccgcccgcggggggcgggggtgcccgggagccgtgggacgggcgggtagcggcaacctttggggagcagagtggtccccaacgcccaggtgccccggctcgcgctctggcccgggcgaatcgggctataggaagggccacacggatggaagtcctagtccgggtgctcacctcttgtggaacgtgcaaagcctgtcccaggacctctttacactctgggggtctctgcccaggcacgcttgctgcttccggacacagctgtgggcggagctagtaggggcggggctacgtgattgacacttctctcctcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagagctggagctggtgcagaatgccttcttcactgaccccaatgaccagagtgcctggttttatcaccgttggctcctaggccgagctgacccccaggatgcactgcgctgcctgcatgtgagccgggacgaggcctgtctgactgtctccttctctcggcccctcttagtgggctccaggatggagatcttgctgctcatggttgatgattctcccctgattgtggagtggaggaccccagatggcaggaaccggcccagccatgtctggctctgtgacctgcctgctgcctccctcaacgaccagttgccccaacatacatttcgcgtcatttggacagcaggcgatgtccagaaagaatgcgtgcttttaaaaggccgccaggagggctggtgccgggactccacgacagacgagcagctattcaggtgtgagctgtcagtggagaagtccacagtgctgcagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggtgctgcaggccagtgataatgccatagagtccctggacggcgtcaccaacctaccccggctgcaggagctgctactgtgcaacaaccgcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctaccaa

SEQ ID NO: 361673 - DNA, 3086 bp, Homo sapiens
  misc_feature (3086)..(3086): n is a, c, g, or t
ttcgatgagccgggacgtggcgccgctctagccagcgcctgggctctgtggcgggcgccgcagctccgcgtcccccgcgcctcctcccagcgcaggtgggtccgcccgcggggggcgggggtgcccgggagccgtgggacgggcgggtagcggcaacctttggggagcagagtggtccccaacgcccaggtgccccggctcgcgctctggcccgggcgaatcgggctataggaagggccacacggatggaagtcctagtccgggtgctcacctcttgtggaacgtgcaaagcctgtcccaggacctctttacactctgggggtctctgcccaggcacgcttgctgcttccggacacagctgtgggcggagctagtaggggcggggctacgtgattgacacttctctcctcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagagctggagctggtgcagaatgccttcttcactgaccccaatgaccagagtgcctggttttatcaccgttggctcctaggccgagctgacccccaggatgcactgcgctgcctgcatgtgagccgggacgaggcctgtctgactgtctccttctctcggcccctcttagtgggctccaggatggagatcttgctgctcatggttgatgattctcccctgattgtggagtggaggaccccagatggcaggaaccggcccagccatgtctggctctgtgacctgcctgctgcctccctcaacgaccagttgccccaacatacatttcgcgtcatttggacagcaggcgatgtccagaaagaatgcgtgcttttaaaaggccgccaggagggctggtgccgggactccacgacagacgagcagctattcaggtgtgagctgtcagtggagaagtccacagtgctgcagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggtgctgcaggccagtgataatgccatagagtccctggacggcgtcaccaacctaccccggctgcaggagctgctactgtgcaacaaccgcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctaccaaaaaaaaaaaaaaaaaaaaaaaaaaaaaaaaaaaaaaaaaaaaaaaaaaaaaaaaaaaaaaaaaaaaagaagaggggggcggcgcagcaaaaaatcatccaccaagagggggccacacaaaaagcccgcgaaacaacgtagtgagtaacagaaaggggacccaacagagagggagagcgccacatatatagcacgagcgacacgacagcgaggagaaaaaaacaacagagccacgagcagagggcaacccacccgcaggagaccgagggaacagccaccacttggggaggccacgaccccacgccctacagagcgggggcgaaggccaacaacaaagaggagcagaccacaaaacaccaccaccacacggaaaaaactagaagacaaccacgggagggagcaacaccaaaaaacacaagagaagaaagagaacaaaacaagtgaggcaacaaacacaagaagcagaaggaagacacaagatacagcagaaggagaaagacacaacaataccggcgacacaaaagcgggacacagtagtcccagacaagacagaagtaatatttaagcacacggggggaccagaagacatacaaaacaaacacaacaaacagaagcgaacggaccaacccccagaccaggacggagcgagcaagaaccgaaaacagacaacaggacgacgaaccaggaagaaggaacgacgacaggacagaagagaaagagacgcacggaaaaagaggagcgggaggaaagaggaagaagaggagcgacaaggagaacagagacgagcaacggcacaaccagagagcggagacaagaacgaagggagaccaccaagagagn

SEQ ID NO: 361674 - DNA, 2298 bp, Homo sapiens
ttcgatgagccgggacgtggcgccgctctagccagcgcctgggctctgtggcgggcgccgcagctccgcgtcccccgcgcctcctcccagcgcaggtgggtccgcccgcggggggcgggggtgcccgggagccgtgggacgggcgggtagcggcaacctttggggagcagagtggtccccaacgcccaggtgccccggctcgcgctctggcccgggcgaatcgggctataggaagggccacacggatggaagtcctagtccgggtgctcacctcttgtggaacgtgcaaagcctgtcccaggacctctttacactctgggggtctctgcccaggcacgcttgctgcttccggacacagctgtgggcggagctagtaggggcggggctacgtgattgacacttctctcctcagacttcaagggctaccactggacccttcccctgtcttgaaccctgagccggcaccatggtcagcttctgcaaggcaacctgcactcttccaacccgttcatccttgtagcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagagctggagctggtgcagaatgccttcttcactgaccccaatgaccagagtgcctggttttatcaccgttggctcctaggccgagctgacccccaggatgcactgcgctgcctgcatgtgagccgggacgaggcctgtctgactgtctccttctctcggcccctcttagtgggctccaggatggagatcttgctgctcatggttgatgattctcccctgattgtggagtggaggaccccagatggcaggaaccggcccagccatgtctggctctgtgacctgcctgctgcctccctcaacgaccagttgccccaacatacatttcgcgtcatttggacagcaggcgatgtccagaaagaatgcgtgcttttaaaaggccgccaggagggctggtgccgggactccacgacagacgagcagctattcaggtgtgagctgtcagtggagaagtccacagtgctgcagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggtgctgcaggccagtgataatgccatagagtccctggacggcgtcaccaacctaccccggctgcaggagctgctactgtgcaacaaccgcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctaccaa

SEQ ID NO: 361675 - DNA, 2308 bp, Homo sapiens
ttcgatgagccgggacgtggcgccgctctagccagcgcctgggctctgtggcgggcgccgcagctccgcgtcccccgcgcctcctcccagcgcaggtgggtccgcccgcggggggcgggggtgcccgggagccgtgggacgggcgggtagcggcaacctttggggagcagagtggtccccaacgcccaggtgccccggctcgcgctctggcccgggcgaatcgggctataggaagggccacacggatggaagtcctagtccgggtgctcacctcttgtggaacgtgcaaagcctgtcccaggacctctttacactctgggggtctctgcccaggcacgcttgctgcttccggacacagctgtgggcggagctagtaggggcggggctacgtgattgacacttctctcctcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagagctggagctggtgcagaatgccttcttcactgaccccaatgaccagagtgcctggttttatcaccgttggctcctaggccgagctgacccccaggatgcactgcgctgcctgcatgtgagccgggacgaggcctgtctgactgtctccttctctcggcccctcttagtgggctccaggatggagatcttgctgctcatggttgatgattctcccctgattgtggagtggaggaccccagatggcaggaaccggcccagccatgtctggctctgtgacctgcctgctgcctccctcaacgaccagttgccccaacatacatttcgcgtcatttggacagcaggcgatgtccagaaagaatgcgtgcttttaaaaggccgccaggagggctggtgccgggactccacgacagacgagcagctattcaggtgtgagctgtcagtggagaagtccacagtgctgcagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggtgctgcaggccagtgataatgccatagagtccctggacggcgtcaccaacctaccccggctgcaggagctgctactgtgcaacaaccgcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctaccaaaaaaaaacacaacaaaacacaaaaacaaaaacaaacacaacaacacaacacacccaaaccc

SEQ ID NO: 361676 - DNA, 1208 bp, Homo sapiens
gtatctagagatccctcataatgtgtgccaagggcgctcctgaggatgtgctgctcaaagctggagctggtgcagaatgccttcttcactgaccccaatgaccagagtgcctggttttatcaccgttggctcctaggccgagctgacccccaggatgcactgcgctgcctgcatgtgagccgggacgaggcctgtctgactgtctccttctctcggcccctcttagtgggctccaggatggagatcttgctgctcatggttgatgattctcccctgattgtggagtggaggaccccagatggcaggaaccggcccagccatgtctggctctgtgacctgcctgctgcctccctcaacgaccagttgccccaacatacatttcgcgtcatttggacagcaggcgatgtccagaaagaatgcgtgcttttaaaaggccgccaggagggctggtgccgggactccacgacagacgagcagctattcaggtgtgagctgtcagtggagaagtccacagtgctgcagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggtgctgcaggccagtgataatgccatagagtccctggacggcgtcaccaacctaccccggctgcaggagctgctactgtgcaacaaccgcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctaccaa

SEQ ID NO: 361677 - DNA, 1285 bp, Homo sapiens
  misc_feature (1190)..(1190): n is a, c, g, or t
  misc_feature (1243)..(1243): n is a, c, g, or t
ttcgatgagccgggacgtggcgccgctctagccagcgcctgggctctgtggcgggcgccgcagctccgcgtcccccgcgcctcctcccagcgcaggtgggtccgcccgcggggggcgggggtgcccgggagccgtgggacgggcgggtagcggcaacctttggggagcagagtggtccccaacgcccaggtgccccggctcgcgctctggcccgggcgaatcgggctataggaagggccacacggatggaagtcctagtccgggtgctcacctcttgtggaacgtgcaaagcctgtcccaggacctctttacactctgggggtctctgcccaggcacgcttgctgcttccggacacagctgtgggcggagctagtaggggcggggctacgtgattgacacttctctcctcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagagctggagctggtgcagaatgccttcttcactgaccccaatgaccagagtgcctggttttatcaccgttggctcctaggccgagtgaccccangatcactggctgctgatgtgaccggacaagctgctgctgctctttttggcctntatggctcagatgaacttgtgtatgtgtatctcctatgggag

SEQ ID NO: 361678 - DNA, 1260 bp, Homo sapiens
ttcgatgagccgggacgtggcgccgctctagccagcgcctgggctctgtggcgggcgccgcagctccgcgtcccccgcgcctcctcccagcgcaggtgggtccgcccgcggggggcgggggtgcccgggagccgtgggacgggcgggtagcggcaacctttggggagcagagtggtccccaacgcccaggtgccccggctcgcgctctggcccgggcgaatcgggctataggaagggccacacggatggaagtcctagtccgggtgctcacctcttgtggaacgtgcaaagcctgtcccaggacctctttacactctgggggtctctgcccaggcacgcttgctgcttccggacacagctgtgggcggagctagtaggggcggggctacgtgattgacacttctctcctcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagggtaaccagggtcagggatgctcaggaggactctgcagtgccacccttccagcccccatgcctgaccctgttcctgaacctgtcactcaggtttattgagcacctacttcatgcgtggctccaggggtgcttaagaatcagtccctggctgaaggaagcttaa

SEQ ID NO: 361679 - DNA, 871 bp, Homo sapiens
agcggaagcgctcgcctctgggcccgccttcggggcccggatctcaaacagtcgggaagaagcaccgtggctgctattatctgctctccgcgcctgacccctcccaggactcgtgatgccaaggccgctgcgagcggctacgaagagtcggggttgagccccagctgagccgagggctcgcactcttctggtctcccaggcccaacccacctgaaggtaaacgcctcctcagctgcggccttctctcctgcggggccccctccccagactcggctgccaaaacgctctgcccctctctcccgccaccctttttattccaggaccttaacctctgcctgccttcgcggctctcagcagaacgtgtaacgcatagtttcaaatgagaaacttaaaaagcgacgtatctatgttgagttcctgaagttttctaaataattcccccataacaccaaacatgaggcagttttctcattccttcacgaattggcatgccatagagtcagtatttttccatttgtgatggttgatcttcccatctcaaatacacaccgcacgctctttttaaatcagaaatttgaatttggttgagcctgatattttcacggtaatttgctgactttgtaagataagatgtgaaaattactgattacatttgtaaactttatatacatatacacacatacctacaggtctgtctcttcgaggcaccaagcctatttatataatgtatcatttcataatttgggcaataagcaaaattagcgtttcgaaagaagtttatattgtcgatacataaagcttaaatttactccttaaatcatactaaaaggggaaaagaaaattttcctcttaacacaccactccagagaaa

SEQ ID NO: 361680 - DNA, 1171 bp, Homo sapiens
agcggaagcgctcgcctctgggcccgccttcggggcccggatctcaaacagtcgggaagaagcaccgtggctgctattatctgctctccgcgcctgacccctcccaggactcgtgatgccaaggccgctgcgagcggctacgaagagtcggggttgagccccagctgagccgagggctcgcactcttctggtctcccaggcccaacccacctgaagaaatgagtggtggattggctccaagtaagagcacagtgtatgtatccaacttgcctttttccctgacaaacaatgacttgtaccggatattttccaagtatggcaaagttgtaaaggttaccatcatgaaagataaagataccaggaagagtaaaggggttgcatttattttatttttggataaagactctgcacaaaactgtaccagggcaataaacaacaaacagttatttggtagagtgataaaagcaagcattgctattgacaatggaagagcagctgagttcatccgaaggcgaaactactttgataaatctaagtgttatgaatgtggggaaagtggacacttaagttatgcctgtccgaaaaatatgctcggagaacgtgagcctccaaagaagaaagaaaaaaagaaaaaaaagaaagctcctgaaccagaagaagaaattgaggaagtagaagaaagtgaagatgaaggggaggatcctgctcttgacagcctcagtcaggccatagcattccagcaagccaaaattgaagaagaacaaaaaaaatggaaacccagttcaggagtcccctcaacatcagatgattcaagacgcccaaggataaagaaaagcacatatttcagtgatgaggaagaacttagtgattaaaatcttgccccagcacagtaataaaaatcaagatttgttagtaacaatcttgaagagctaattttaataaaaataagaaaaattaatactatcatgttaatactattattgtcatcccaagaaaaaagatattttaaaaatttatttgaaaagttcattataagggctttattcatgcctgatttgtttacatgaggacttctgaaattaatccttaaaacaaacttcctgaagaccgaaaagttgaatgatttattgttacttatattaataaacttttcaagagaattttgtcttta

SEQ ID NO: 361681 - DNA, 1856 bp, Homo sapiens
agcggaagcgctcgcctctgggcccgccttcggggcccggatctcaaacagtcgggaagaagcaccgtggctgctattatctgctctccgcgcctgacccctcccaggactcgtgatgccaaggccgctgcgagcggctacgaagagtcggggttgagccccagctgagccgagggctcgcactcttctggtctcccaggcccaacccacctgaagaaatgagtggtggattggctccaagtaagagcacagtgtatgtatccaacttgcctttttccctgacaaacaatgacttgtaccggatattttccaagtatggcaaagttgtaaaggttaccatcatgaaagataaagataccaggaagagtaaaggggttgcatttattttatttttggataaagactctgcacaaaactgtaccagggcaataaacaacaaacagttatttggtagagtgataaaagcaagcattgctattgacaatggaagagcagctgagttcatccgaaggcgaaactactttgataaatctaagtgttatgaatgtggggaaagtggacacttaagttatgcctgtccgaaaaatatgctcggagaacgtgagcctccaaagaagaaagaaaaaaagaaaaaaaagaaagctcctgaaccagaagaagaaattgaggaagtagaagaaagtgaagatgaaggggaggatcctgctcttgacagcctcagtcaggccatagcattccagcaagccaaaattgaagaagaacaaaaaaaatggaaacccagttcaggagtcccctcaacatcagatgattcaagacgcccaaggataaagaaaagcacatatttcagtgatgaggaagaacttagtgattaaaatcttgccccagcacagtaataaaaatcaagatttgttagtaacaatcttgaagagctaattttaataaaaataagaaaaattaatactatcatgttaatactattattgtcatcccaagaaaaaagatattttaaaaatttatttgaaaagttcattataagggctttattcatgcctgatttgtttacatgaggacttctgaaattaatccttaaaacaaacttcctgaagaccgaaaagttgaatgatttattgttacttatattaataaacttttcaagagaattttgtctttaaaaaaaaatgttttgtcatcatatttcttgtagctttatcccaatctggataaattgtaaatacctataaaataaattataaatacctataaaatataaagtaacatagctctaaaaggcttaaaatcaaacacaggtgttatttgtctgccctacccatagcaccaaattccattccctagaagaaactacttacatgtgcacacatgtagctaaataaagtacatatatttcagtcacttaataaaagaataaaggagaattattcaatctcttatacttctcctaccttcctcaatattcccaatgtggctgtattaaaaatttgggggaatccatatatatcttttttaataaccaagtaaatacttttcatttctgagccaaggaatatgctatgattacgttttttcctagagttaataattgtctattttttttccatgtattgtctttgtatttatgactaaatcttcccattctgtctgcaggtgggtatatggtaatgggattagagagcctttaattttctgctttgtatatttctatattgtttaactttgtaagaatgcccattacttttttaactagtaaaagcaatagaaataagttaatactatcatagtaatattattattgtcatcccaagaaaaaatatattaaaaagatatttgaaatttcatta

SEQ ID NO: 361682 - DNA, 1085 bp, Homo sapiens
ccactcccccccgtttagcagcccgcacacgctctgcatccatctctgggaaaggtaaaaagcgctcaccgactctggccctccgggagaccccgtaaatgcagccgtccgctcgccgccgttatcccagaaatgagtggtggattggctccaagtaagagcacagtgtatgtatccaacttgcctttttccctgacaaacaatgacttgtaccggatattttccaagtatggcaaagttgtaaaggttaccatcatgaaagataaagataccaggaagagtaaaggggttgcatttattttatttttggataaagactctgcacaaaactgtaccagggcaataaacaacaaacagttatttggtagagtgataaaagcaagcattgctattgacaatggaagagcagctgagttcatccgaaggcgaaactactttgataaatctaagtgttatgaatgtggggaaagtggacacttaagttatgcctgtccgaaaaatatgctcggagaacgtgagcctccaaagaagaaagaaaaaaagaaaaaaaagaaagctcctgaaccagaagaagaaattgaggaagtagaagaaagtgaagatgaaggggaggatcctgctcttgacagcctcagtcaggccatagcattccagcaagccaaaattgaagaagaacaaaaaaaatggaaacccagttcaggagtcccctcaacatcagatgattcaagacgcccaaggataaagaaaagcacatatttcagtgatgaggaagaacttagtgattaaaatcttgccccagcacagtaataaaaatcaagatttgttagtaacaatcttgaagagctaattttaataaaaataagaaaaattaatactatcatgttaatactattattgtcatcccaagaaaaaagatattttaaaaatttatttgaaaagttcattataagggctttattcatgcctgatttgtttacatgaggacttctgaaattaatccttaaaacaaacttcctgaagaccgaaaagttgaatgatttattgttacttatattaataaacttttcaagagaattttgtcttta

SEQ ID NO: 361683 - DNA, 1085 bp, Homo sapiens
agcggaagcgctcgcctctgggcccgccttcggggcccggatctcaaacagtcgggaagaagcaccgtggctgctattatctgctctccgcgcctgacccctcccaggactcgtgatgccaaggccgctgcgagcggctacgaagagtcggggttgagccccagctgagccgagggctcgcactcttctggtctcccaggcccaacccacctgaagatattttccaagtatggcaaagttgtaaaggttaccatcatgaaagataaagataccaggaagagtaaaggggttgcatttattttatttttggataaagactctgcacaaaactgtaccagggcaataaacaacaaacagttatttggtagagtgataaaagcaagcattgctattgacaatggaagagcagctgagttcatccgaaggcgaaactactttgataaatctaagtgttatgaatgtggggaaagtggacacttaagttatgcctgtccgaaaaatatgctcggagaacgtgagcctccaaagaagaaagaaaaaaagaaaaaaaagaaagctcctgaaccagaagaagaaattgaggaagtagaagaaagtgaagatgaaggggaggatcctgctcttgacagcctcagtcaggccatagcattccagcaagccaaaattgaagaagaacaaaaaaaatggaaacccagttcaggagtcccctcaacatcagatgattcaagacgcccaaggataaagaaaagcacatatttcagtgatgaggaagaacttagtgattaaaatcttgccccagcacagtaataaaaatcaagatttgttagtaacaatcttgaagagctaattttaataaaaataagaaaaattaatactatcatgttaatactattattgtcatcccaagaaaaaagatattttaaaaatttatttgaaaagttcattataagggctttattcatgcctgatttgtttacatgaggacttctgaaattaatccttaaaacaaacttcctgaagaccgaaaagttgaatgatttattgttacttatattaataaacttttcaagagaattttgtcttta

SEQ ID NO: 361684 - DNA, 1268 bp, Homo sapiens
agcggaagcgctcgcctctgggcccgccttcggggcccggatctcaaacagtcgggaagaagcaccgtggctgctattatctgctctccgcgcctgacccctcccaggactcgtgatgccaaggccgctgcgagcggctacgaagagtcggggttgagccccagctgagccgagggctcgcactcttctggtctcccaggcccaacccacctgaagaaatgagtggtggattggctccaagtaagagcacagtgtatgtatccaacttgcctttttccctgacaaacaatgacttgtaccggatattttccaagtatggcaaagttgtaaaggttaccatcatgaaagataaagataccaggaagagtaaaggggttgcatttattttatttttggataaagactctgcacaaaactgtaccagggcaataaacaacaaacagttatttggtagagtgataaaagcaagcattgctattgacaatggaagagcagctgagttcatccgaaggcgaaactactttgataaatctaagtgttatgaatgtgggggacacttaagttatgcctgtccgaaaaatatgctcggagaacgtgagcctccaaagaagaaactactttgataaatctaagtgttatgaatgtggggaaagtggacacttaagttatgcctgtccgaaaaatatgctcggagaacgtgagcctccaaagaagaaagaaaaaaagaaaaaaaagaaagctcctgaaccagaagaagaaattgaggaagtagaagaaagtgaagatgaaggggaggatcctgctcttgacagcctcagtcaggccatagcattccagcaagccaaaattgaagaagaacaaaaaaaatggaaacccagttcaggagtcccctcaacatcagatgattcaagacgcccaaggataaagaaaagcacatatttcagtgatgaggaagaacttagtgattaaaatcttgccccagcacagtaataaaaatcaagatttgttagtaacaatcttgaagagctaattttaataaaaataagaaaaattaatactatcatgttaatactattattgtcatcccaagaaaaaagatattttaaaaatttatttgaaaagttcattataagggctttattcatgcctgatttgtttacatgaggacttctgaaattaatccttaaaacaaacttcctgaagaccgaaaagttgaatgatttattgttacttatattaataaacttttcaagagaattttgtcttta

SEQ ID NO: 361685 - DNA, 870 bp, Homo sapiens
agcagcagaaaatacattcttcctaagtgcacatggaacattcttgaggacaactcacatgttaggccacaaaacgagtcttaataaactttagaagactgaaatcataccaagtatcttttctgaccacaatggtatgaaactagaaataataaaaagaattttggaaaatttcacaaatacaaagaaattgaacaacatgctcgtgaacaatagccagacaaggacactacaagaaaagaaaattatagaccaatgggactacatcagcatagatacaaaaatcctcaataaggccaggtgcaatgtggctcacacctgtaataccagcactttaaaagactgagacaggaggattacttgagcccaggagtttaaggcctgcagtaaaccaagattatgccactgcactccagcctgggtgacaaagcaagaccagcaagccaaaattgaagaagaacaaaaaaaatggaaacccagttcaggagtcccctcaacatcagatgattcaagacgcccaaggataaagaaaagcacatatttcagtgatgaggaagaacttagtgattaaaatcttgccccagcacagtaataaaaatcaagatttgttagtaacaatcttgaagagctaattttaataaaaataagaaaaattaatactatcatgttaatactattattgtcatcccaagaaaaaagatattttaaaaatttatttgaaaagttcattataagggctttattcatgcctgatttgtttacatgaggacttctgaaattaatccttaaaacaaacttcctgaagaccgaaaagttgaatgatttattgttacttatattaataaacttttcaagagaattttgtcttta

SEQ ID NO: 361686 - DNA, 806 bp, Homo sapiens
agcggaagcgctcgcctctgggcccgccttcggggcccggatctcaaacagtcgggaagaagcaccgtggctgctattatctgctctccgcgcctgacccctcccaggactcgtgatgccaaggccgctgcgagcggctacgaagagtcggggttgagccccagctgagccgagggctcgcactcttctggtctcccaggcccaacccacctgaagaaatgagtggtggattggctccaagtaagagcacagtgtatgtatccaacttgcctttttccctgacaaacaatgacttgtaccggatattttccaagtatggcaaagttgtaaaggttaccatcatgaaagataaagataccaggaagagtaaaggggttgcatttattttatttttggataaagactctgcacaaaactgtaccagggcaataaacaacaaacagttatttggtagagtgataaaagcaagcattgctattgacaatggaagagcagctgagttcatccgaaggcgaaactactttgataaatctaagtgttatgaatgtggggaaagtggacacttaagttatgcctgtccgaaaaatatgctcggagaacgtgagcctccaaagaagaaagaaaaaaagaaaaaaacaagcaaccccatcaaaaagtaggcaaaggatatgaaaagacacttctcaaaagaaaacatttatgcagccaacagacatatgaaaaaatgctcatcatcactgatcatcaaagaaatgcaaatcaaaatcacaatgagacaccatctcatgccagttagaatggtgatc

SEQ ID NO: 361687 - DNA, 1122 bp, Homo sapiens
agcggaagcgctcgcctctgggcccgccttcggggcccggatctcaaacagtcgggaagaagcaccgtggctgctattatctgctctccgcgcctgacccctcccaggactcgtgatgccaaggccgctgcgagcggctacgaagagtcggggttgagccccagctgagccgagggctcgcactcttctggtctcccaggcccaacccacctgaagaaatgagtggtggattggctccaagtaagagcacagtatattttccaagtatggcaaagttgtaaaggttaccatcatgaaagataaagataccaggaagagtaaaggggttgcatttattttatttttggataaagactctgcacaaaactgtaccagggcaataaacaacaaacagttatttggtagagtgataaaagcaagcattgctattgacaatggaagagcagctgagttcatccgaaggcgaaactactttgataaatctaagtgttatgaatgtggggaaagtggacacttaagttatgcctgtccgaaaaatatgctcggagaacgtgagcctccaaagaagaaagaaaaaaagaaaaaaaagaaagctcctgaaccagaagaagaaattgaggaagtagaagaaagtgaagatgaaggggaggatcctgctcttgacagcctcagtcaggccatagcattccagcaagccaaaattgaagaagaacaaaaaaaatggaaacccagttcaggagtcccctcaacatcagatgattcaagacgcccaaggataaagaaaagcacatatttcagtgatgaggaagaacttagtgattaaaatcttgccccagcacagtaataaaaatcaagatttgttagtaacaatcttgaagagctaattttaataaaaataagaaaaattaatactatcatgttaatactattattgtcatcccaagaaaaaagatattttaaaaatttatttgaaaagttcattataagggctttattcatgcctgatttgtttacatgaggacttctgaaattaatccttaaaacaaacttcctgaagaccgaaaagttgaatgatttattgttacttatattaataaacttttcaagagaattttgtcttta

SEQ ID NO: 361688 - DNA, 1026 bp, Homo sapiens
gtaaccaaaaaaaactttttcctagggcctgtcttatagactgaaggctgaaattattcataaactgtaacaaagaatttggtcaatgtctgcaacctaaaaatttgatgttttatgattttaaaataaattgtaaatatttggtcttttgtttcagatattttccaagtatggcaaagttgtaaaggttaccatcatgaaagataaagataccaggaagagtaaaggggttgcatttattttatttttggataaagactctgcacaaaactgtaccagggcaataaacaacaaacagttatttggtagagtgataaaagcaagcattgctattgacaatggaagagcagctgagttcatccgaaggcgaaactactttgataaatctaagtgttatgaatgtggggaaagtggacacttaagttatgcctgtccgaaaaatatgctcggagaacgtgagcctccaaagaagaaagaaaaaaagaaaaaaaagaaagctcctgaaccagaagaagaaattgaggaagtagaagaaagtgaagatgaaggggaggatcctgctcttgacagcctcagtcaggccatagcattccagcaagccaaaattgaagaagaacaaaaaaaatggaaacccagttcaggagtcccctcaacatcagatgattcaagacgcccaaggataaagaaaagcacatatttcagtgatgaggaagaacttagtgattaaaatcttgccccagcacagtaataaaaatcaagatttgttagtaacaatcttgaagagctaattttaataaaaataagaaaaattaatactatcatgttaatactattattgtcatcccaagaaaaaagatattttaaaaatttatttgaaaagttcattataagggctttattcatgcctgatttgtttacatgaggacttctgaaattaatccttaaaacaaacttcctgaagaccgaaaagttgaatgatttattgttacttatattaataaacttttcaagagaattttgtcttta

SEQ ID NO: 361689 - DNA, 409 bp, Homo sapiens
catgattagcactgcactccagtcctttatgtaattatcttattcaatcttacaacaattttatatggctataagtgaataagtgtcttgtccatggccgcacaactccagagcccctatctacatattctttttcctatgggttgcaaaggagaggctttgcacaaaatctaagtaaggctgaagaaagaaatatataaagatggttattttattatagtaaaatcttgactgcctggtacacaggtggtgtgatttcttctttgaaatcaaaatttcacatgattgtatttactcttaatcaatgctaattcaaaagcaccctcttgacaattcatcatccagaaataacctcttactcctttcccttttcatttcaattggaaaaaaaataattataacaaattga

SEQ ID NO: 361690 - DNA, 1647 bp, Homo sapiens
ttttagaagtgagtgatgcaataaactgtgtgatcatttttacaaagtcaataggttttattgaaaatactggtttctgtcagtatgtttgcttgttattacactgtgttgtaccagtcttaataattaatttgtttgtgtttttactatttaccaacaggctaatgtatttatactacatattttcttccatagaactccactttgacaattgaagaatttcattccaaactgcaagaagctactaacttcccactgagaccttttgtcatcccatttttgaagaggtattgcacagttcactggtctgtaaagtattttaaaccatattgttgctaggtcataactgtgtgcttttttagtacatttaggggctctttgatttaatttaatggatgaaaactatctgaatcgattgtatttatgaccatttcctaagtagtctgaaaattacaaggagtgttttaaataattacctgaaaagaagtaaagtttgaagaagagtttagaagtcctctttgaataaaggttttgttcatttttttggtcatatgagatatgttattttacattttgcttgtctttagagtgaacagaagattggttgagctttgtagttgttcaggatttttttatcctcctaattttatctttgtaacaacttaacgggaagatcagaccgtcatccttttgtgccagtgaagaagttgggagtaagtgacatgtccaaggtgtgcctggctgaggactgattgaggtgtgggattcgaaatggtttttaagtctctgctgtgagctttctgtctcctccaactgctgccgcttcagtaaagcaactggaaaacaaacaaacacaaagttcacaagagaaagaaggaacatttttattcagcatagcgggtagttaattcactgatggatactaaaataactggtagttttggtagaaaagcagattactaagatcccttttacttgggtaagcatattgcttgggcatagtggattctcaataagtttatactaacagtgggcttagcagattgataaatgtgaaagtttcatttgcactcccctttgaaggtcactttcaaaatgagcactcaaggaagcctctgatttaattatttgccaaggaggatttacctttctgtctggttcctagaactttgtttgggagacaccagaaatataactgatcagatcctgtgtgaaatttcatctatttttaaaactgtatcagacacataaggttcaagtaagtatccagaagcctagaaaggtttgtctgaaatgagccccaattctgaactttctggatattagtctttcctgttgttattattaaggtgaaatgaaatattctgctttgtgagtacctacaaaccagaaattagatctgtttgtgtggaaacccagattacaattatattcttttcgttcttttctaagttgtacatttaaggttaaaggtataatgtgttagtgttttctcccaaaatggcttatactataatactatattcttatttaaaagcaaattgtttgttgaacaatttgaacaagtttgttgagactagaatctttgcctttctcagaaagcgttgttttctgtaaagatttcatcatatgaatgccatttcctgt

SEQ ID NO: 361691 - DNA, 4272 bp, Homo sapiens
catagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaaatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatgg

SEQ ID NO: 361692 - DNA, 2369 bp, Homo sapiens
tggcgaattcggcacgaggcaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatgg

SEQ ID NO: 361693 - DNA, 2334 bp, Homo sapiens
aaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatgg

SEQ ID NO: 361694 - DNA, 3942 bp, Homo sapiens
catagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaaatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaagaggtattgcacagttcactggtctgtaaagtattttaaaccatattgttgctaggtcataactgtgtgcttttttagtacatttaggggctctttgatttaatttaatggatgaaaactatctgaatcgattgtatttatgaccatttcctaagtagtctgaaaattacaaggagtgttttaaataattacctgaaaagaagtaaagtttgaagaagagtttagaagtcctctttgaataaaggttttgttcatttttttggtcatatgagatatgttattttacattttgcttgtctttagagtgaacagaagattggttgagctttgtagttgttcaggatttttttatcctcctaattttatctttgtaacaacttaacgggaagatcagaccgtcatccttttgtgccagtgaagaagttgggagtaagtgacatgtccaaggtgtgcctggctgaggactgattgaggtgtgggattcgaaatggtttttaagtctctgctgtgagctttctgtctcctccaactgctgccgcttcagtaaagcaactggaaaacaaacaaacacaaagttcacaagagaaagaaggaacatttttattcagcatagcgggtagttaattcactgatggatactaaaataactggtagttttggtagaaaagcagattactaagatcccttttacttgggtaagcatattgcttgggcatagtggattctcaataagtttatactaacagtgggcttagcagattgataaatgtgaaagtttcatttgcactcccctttgaaggtcactttcaaaatgagcactcaaggaagcctctgatttaattatttgccaaggaggatttacctttctgtctggttcctagaactttgtttgggagacaccagaaatataactgatcagatcctgtgtgaaatttcatctatttttaaaactgtatcagacacataaggttcaagtaagtatccagaagcctagaaaggtttgtctgaaatgagccccaattctgaactttctggatattagtctttcctgttgttattattaaggtgaaatgaaatattctgctttgtgagtacctacaaaccagaaattagatctgtttgtgtggaaacccagattacaattatattcttttcgttcttttctaagttgtacatttaaggttaaaggtataatgtgttagtgttttctcccaaaatggcttatactataatactatattcttatttaaaagcaaattgtttgttgaacaatttgaacaagtttgttgagactagaatctttgcctttctcagaaagcgttgttttctgtaaagatttcatcatatgaatgccatttcctgt

SEQ ID NO: 361695 - DNA, 3304 bp, Homo sapiens
tggcgaattcggcacgaggcaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacacgcacatatatacacacacacacacacacacacacacacacacacacacacacacacagaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttatagg

SEQ ID NO: 361696 - DNA, 5275 bp, Homo sapiens
catagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaaataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacacgcacatatatacacacacacacacacacacacacacacacacacacacacacacacagaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttatagg

SEQ ID NO: 361697 - DNA, 3163 bp, Homo sapiens
gggaagttttattgtgctagctcggagcctgtggcggatggtgggactctccgtgccctgtggagtatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacacgcacatatatacacacacacacacacacacacacacacacacacacacacacacacagaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttatagg

SEQ ID NO: 361698 - DNA, 3269 bp, Homo sapiens
aaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacacgcacatatatacacacacacacacacacacacacacacacacacacacacacacacagaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttatagg

SEQ ID NO: 361699 - DNA, 3538 bp, Homo sapiens
tggcgaattcggcacgaggcaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagctattttcccaccagctctttcccagtatttcatatttgaatgtattgtgacttttgactatccttgcacagtcttaagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactaggatgaaggccatacctaggtgctgcccagctttgagcattgctgtcctgggtcatatgaggtcacattgcttctccaaaggctatcagctcatcccttcatgtatattgatggcggcccttgcagtatctagtatccaatggtctccatcctgtcacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacacgcacatatatacacacacacacacacacacacacacacacacacacacacacacacagaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttatagg

SEQ ID NO: 361700 - DNA, 5555 bp, Homo sapiens
catagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaagcaaacagaaccctgcccagtacctcgcccagcatgaacagctgcttctggatgccagcaccacctcacctgttgactcctcagagctgcttctcgatgtgaacgaaaacgggaagaggcgaactccagacagctattttcccaccagctctttcccagtatttcatatttgaatgtattgtgacttttgactatccttgcacagtcttaagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactaggatgaaggccatacctaggtgctgcccagctttgagcattgctgtcctgggtcatatgaggtcacattgcttctccaaaggctatcagctcatcccttcatgtatattgatggcggcccttgcagtatctagtatccaatggtctccatcctgtcacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacacgcacatatatacacacacacacacacacacacacacacacacacacacacacacacagaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttatagg

SEQ ID NO: 361701 - DNA, 3146 bp, Homo sapiens
ttttagaagtgagtgatgcaataaactgtgtgatcatttttacaaagtcaataggttttattgaaaatactggtttctgtcagtatgtttgcttgttattacactgtgttgtaccagtcttaataattaatttgtttgtgtttttactatttaccaacaggctaatgtatttatactacatattttcttccatagaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagctattttcccaccagctctttcccagtatttcatatttgaatgtattgtgacttttgactatccttgcacagtcttaagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactaggatgaaggccatacctaggtgctgcccagctttgagcattgctgtcctgggtcatatgaggtcacattgcttctccaaaggctatcagctcatcccttcatgtatattgatggcggcccttgcagtatctagtatccaatggtctccatcctgtcacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacacgcacatatatacacacacacacacacacacacacacacacacacacacacacacacagaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttatagg

SEQ ID NO: 361702 - DNA, 2901 bp, Homo sapiens
catagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaaataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgtgtaagtagtcatttcaggcttttgagtttcagttttaaagtttaaattaaatttttttctgcaaatgaaaaatcaagggaaaataaaattcagcatcaatgtattatgcagaaatgaaccaaaaaaaatcatttgtttgccagtaagtaggtactgagcacagaagtatcatagcttaggtctaatttgtgtgactgccaatatttgccttccttttcattattgcttcgaagttgcagtctgctatgattttagcaaatgaagcagcatttggtctgtaattccagttgttaccactgtaacttctaattcatcttaatgtggagctctttattttagtttgttcagcatgacttggaacatggaaatgtgctattattatttctaggttacttcttctaacaccattttcatctatttcaagtggttacaaataatgttaaaatataatatccttgtgttaaaaagggtattgatatgcaacaatatcatacagaaaactttctgaagtgagaagtgcctttcttgcccttttttttgggtggagggggaggacagaatctcgctctgtcacccaggctggag

SEQ ID NO: 361703 - DNA, 3515 bp, Homo sapiens
tgaataaattattcggcatttagcttatcattctgaatttcactttttgctttttggtgctctgaaacttgcagagagaggtggagtgctaaggggagggtaggggttgtgatactttgcacacacatccctgtcattgttctgcctaaagagacagggctgggttcaaggccacatgtgctcctgtcatcctccacatttctgctccaagtgcaatccggagtgtcagctctccatctgtctctgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacacgcacatatatacacacacacacacacacacacacacacacacacacacacacacacagaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttatagg

SEQ ID NO: 361704 - DNA, 2495 bp, Homo sapiens
attttctacgctcgactgctaacattggcttcagcttccagtgcagttgtgctgctgcatataacactaccaaggtagcatctgcctaagccagaaataacaataggatataatataacctagttacaaatgaggtcctgccatctgtgctataccttcttaagtggggtttggatgataaaatcctgatttaaacgtcagtagataagtgtattttattgatagaagatgttgaatttcttctgttcacttgcttttaaaaaagataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatgg

SEQ ID NO: 361705 - DNA, 3455 bp, Homo sapiens
catagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaaatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacaggtgagagggaggaggagcctggatgaaccatgacctttttcccatacctgtggcatgaggaaacatttcatgtcacaattaaaccgctggcctatgtcattcttgcacaatagcaataagccattgtggccatcttgagaatctggctctggcctgggattttacagagttttgaatctctggcctgggacagtttggcttttgtgtaggttaatcttttctgcttgtagtattaaagcgaaatggtgaagacgaatgatttttctgatttgccaagtaccactgatggctcttagatgcacatcaatattaaaattctcattcattatgtaatttaacccaaccacatattttacttcaatattctgaaattggctgttcctagtttccttaaaatgtgatggtttggaagcttgtctgtatgtatttcttaacacagtacagtagttatttgttttggttgtatatgaactaagagaaaacttctgggacactagatgaactgagtgaagataagagttatacagtagagacaatagatggtatttttgctgaaaattttacttgttagatactgttctatcagatactgtgctctcataactaagaattctaagaaatgtaaaataaaaccacttctccattaaaccctacagagtaattgttgaataaagcatacacatgaaatttccc

SEQ ID NO: 361706 - DNA, 2039 bp, Homo sapiens
tggcgaattcggcacgaggcaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaagaggtattgcacagttcactggtctgtaaagtattttaaaccatattgttgctaggtcataactgtgtgcttttttagtacatttaggggctctttgatttaatttaatggatgaaaactatctgaatcgattgtatttatgaccatttcctaagtagtctgaaaattacaaggagtgttttaaataattacctgaaaagaagtaaagtttgaagaagagtttagaagtcctctttgaataaaggttttgttcatttttttggtcatatgagatatgttattttacattttgcttgtctttagagtgaacagaagattggttgagctttgtagttgttcaggatttttttatcctcctaattttatctttgtaacaacttaacgggaagatcagaccgtcatccttttgtgccagtgaagaagttgggagtaagtgacatgtccaaggtgtgcctggctgaggactgattgaggtgtgggattcgaaatggtttttaagtctctgctgtgagctttctgtctcctccaactgctgccgcttcagtaaagcaactggaaaacaaacaaacacaaagttcacaagagaaagaaggaacatttttattcagcatagcgggtagttaattcactgatggatactaaaataactggtagttttggtagaaaagcagattactaagatcccttttacttgggtaagcatattgcttgggcatagtggattctcaataagtttatactaacagtgggcttagcagattgataaatgtgaaagtttcatttgcactcccctttgaaggtcactttcaaaatgagcactcaaggaagcctctgatttaattatttgccaaggaggatttacctttctgtctggttcctagaactttgtttgggagacaccagaaatataactgatcagatcctgtgtgaaatttcatctatttttaaaactgtatcagacacataaggttcaagtaagtatccagaagcctagaaaggtttgtctgaaatgagccccaattctgaactttctggatattagtctttcctgttgttattattaaggtgaaatgaaatattctgctttgtgagtacctacaaaccagaaattagatctgtttgtgtggaaacccagattacaattatattcttttcgttcttttctaagttgtacatttaaggttaaaggtataatgtgttagtgttttctcccaaaatggcttatactataatactatattcttatttaaaagcaaattgtttgttgaacaatttgaacaagtttgttgagactagaatctttgcctttctcagaaagcgttgttttctgtaaagatttcatcatatgaatgccatttcctgt

SEQ ID NO: 361707 - DNA, 5439 bp, Homo sapiens
catagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacacgcacatatatacacacacacacacacacacacacacacacacacacacacacacacagaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttatagg

SEQ ID NO: 361708 - DNA, 3430 bp, Homo sapiens
attttctacgctcgactgctaacattggcttcagcttccagtgcagttgtgctgctgcatataacactaccaaggtagcatctgcctaagccagaaataacaataggatataatataacctagttacaaatgaggtcctgccatctgtgctataccttcttaagtggggtttggatgataaaatcctgatttaaacgtcagtagataagtgtattttattgatagaagatgttgaatttcttctgttcacttgcttttaaaaaagataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacacgcacatatatacacacacacacacacacacacacacacacacacacacacacacacagaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttatagg

SEQ ID NO: 361709 - DNA, 3459 bp, Homo sapiens
tggcgaattcggcacgaggcaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactaggatgaaggccatacctaggtgctgcccagctttgagcattgctgtcctgggtcatatgaggtcacattgcttctccaaaggctatcagctcatcccttcatgtatattgatggcggcccttgcagtatctagtatccaatggtctccatcctgtcacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacacgcacatatatacacacacacacacacacacacacacacacacacacacacacacacagaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttatagg

SEQ ID NO: 361710 - DNA, 3460 bp, Homo sapiens
tgcgacaaaaagctgacatccgaagctgtctgttctatttttgaaacatttcaggtggttggcatatgtgcacatgggaggcagggctggccctgggttgcagcagactccatttattgtcagcctctgtgcaggataccatcactcagtatgaggagtagacccatttagttatagagtacctgagaatgtagtaaccctgtgaagtccaagcatttttaaaaagtcccaacatttaaaaacttataaaactagtagatgtaaaaggtaggaaacttggtggcaatttcctcatgcatgttctctgtaagtttatgacttccttctgattttgtgctcttgacagtaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactaggatgaaggccatacctaggtgctgcccagctttgagcattgctgtcctgggtcatatgaggtcacattgcttctccaaaggctatcagctcatcccttcatgtatattgatggcggcccttgcagtatctagtatccaatggtctccatcctgtcacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacacgcacatatatacacacacacacacacacacacacacacacacacacacacacacacagaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttatagg

SEQ ID NO: 361711 - DNA, 3441 bp, Homo sapiens
tggcgaattcggcacgaggcaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagatgaataaactgaggtccagagaggttaagtgacttgaccaaggtcacacagctagtcatggaagagccaggactagatctcaggtctcttgattcccagtccagtgctctttccactacaccacaatgccagtaagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacacgcacatatatacacacacacacacacacacacacacacacacacacacacacacacagaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttatagg

SEQ ID NO: 361712 - DNA, 465 bp, Homo sapiens
aagctcaaatatgagtgactgaactgtgctggtttctgaatagatgatgaaacaaactcttgttttttccccctttagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatgggtaagactgaaggacctgttcacttcttacgggattgggtgcttgaagacttgcaccattatttctgaacttaacttgaggcttgaaatctgtgatagggatgaagattctcatatcttgctttatattgtctcct

SEQ ID NO: 361713 - DNA, 503 bp, Homo sapiens
ggagttctaggagtcgggagtccagagagtggagaggtccggtaccagtagctgctggttcctgaatagtagtgttctccaacttttccgtatctttttcttacccaatgttcctgagtaattgttcaatacaaaaaattttgcaagattttccttctaaatttaccaaaacttgactcttttcctgcttagtcattaaagaacattttccttacttagtcattaaagaacatttttgagtcatgtgcctgttaccactagaaatctctcttaggatacagacttgttacttatgaatgaattgttgtaaaaatccatttgcagcttagttgtttcagaactcaaaatttattttacaatggagagatgacacatggtgactaggttctcattaaacccataaaagcccatttaacacatataaatatacttgaggtacagtctctcttaataatactgtaaaacctaaccaccataaataatatggtttccatgaaaaaaaa

SEQ ID NO: 361714 - DNA, 698 bp, Homo sapiens
agagtggcttctttttggataatttatgataaaaagggagatctggttgggatctagatacggctgttaaagctgcagtgttccatacctcagagggaccactttggaaatgaattgtccattgctgagtatgaagagatgtccagtccaggcaaagccttcactgaagttccatcatcgccacttctccctttttagggtcattcaaagaagataacaccaaacctaaataattctgaaagcattttgcagatcagtgctactcattcaaagggctttgcaactcaaacagattgttagtgtgctagtgataagtttatttggtagaaatgggtatactacagctttaactagccttagtgagaaaagaaattttttgttgttacaaaacaccttttttaacaaaaaggtattttgagcctacaaaaagtttctttaaactgtcagattctagcattgttaaccaaattagactagtgattgcaatatttaagtgtaaatcttgttctacaagaaaggaaacttgcttacagtttaaaacaatgactgtttctacacatgatcttgtatactactacacaaggaaaagggggttttgtaaacactgtagaacagtctcatattcatttttttatagaaatgttattccaatggtgcattttttgtttaataaataaagttttgatacaaagttcttt

SEQ ID NO: 361715 - DNA, 527 bp, Homo sapiens
gagaactgcggctacaagttctgcgggcgcacgcacatgtacaagcacgcgcagcaccacgaccgcgtggacaacctggtgctggacgacttcaagcgcttcaaggcctcactcagctgccacttcgccgactgccccttctcgggcaccagcacgcacttccactgcctgcgctgccgcttccgctgcaccgacagcaccaaggtcacggcgcatcgcaagcaccacggcaaacaggacgtgatcagcgccgcgggcttctgccagttcagctccagcgccgactgcgccgtgcccgactgcaagtacaagctcaagtgctcgcacttccactgcaccttcccgggctgccgccacacggtggtgggcatgtcgcagatggactcgcacaagcgcaagcacgagaagcaggagcgcggcgagcccgcggcagagggccccgcgcccgggcctcccatcagtctggacggctccctgtcgctgggcgccgagccgggctcgctgctcttcctgcagtcggcggccgc

SEQ ID NO: 361716 - DNA, 632 bp, Homo sapiens
tatcagtacagaaataccacttctcaggggaacaaaatttctgttggcataaaatatgaaagaaagtcttcactgggagctttataggagtactggacgatagaaaaggaaaaaaagcagtcatagatttcatgtggctgtttcttatactgacctcagtcaaaattaaaagcagaaccttatcaatcccagccctatagaggcggttctgcaaggaaataaacaaatgctgtccaaatatagacttctcatggtaaaacatgatctaaggagagaatttagaggttttagactggcatctgcttctaaattctgtttttatttatgagtgtttctcccctttggggacattgtctttgtaaaaccaaacttagaacacccccacacaacaaattgtgctggatttaataacctctacttgctttatcataagtctgtgtggttcaatgtagtgttttattatactggcatatataatttctacttacattgtttcttgttagaggtaatgcatgaatttatccctctcgaggagagaacatgaattaaaaaaaatagtgcctgtaatataatgtgatgattatgatatcacaagcaataaatttttttttacaaaacttgaattgaagtta

SEQ ID NO: 361717 - DNA, 645 bp, Homo sapiens
attttaaagtctcttttttttttttatttttcacaaaggatttgctgtaagtcttcaagtcattttgtccaatccaaaagctgtatttaagcgtcgtggatcccagccagggatgcaagaatctgactttctcaaacagataacaacagtcgaagaactggaaccgaaagcaaataactgcactaaggtattcattacacttgtgctgcccgacctcgagtgtcaccatgaagagtgcgctacccaagctatttccttccccttcaggttctcgtgtggcacactcggacagagaaggttaatctagccaacgagccaaagtaccacctggacacagtgaaaattgaggtataaattgaagcagcaactggtgcagtttgtccagccagtggatccatatggaagaggatgtttggagtttaggctacagagcattcaggtattgtttgttttacttcagtacagcagcctttcttgtcatctgatggacatctgtttaaatggagcttgtcagttaacataagctaattggatggttggtacaaaatgtatgttttgtcttcatttgttctgcatgttttctctacaacaactaaattggaagatttttttgtacagtgccgatactgcaagataccactcttg

SEQ ID NO: 361718 - DNA, 863 bp, Homo sapiens
aacgcgggcctcgcctggctgcgccagaggcaccagcaccagcgcgcgcagcccggcgtgctcttcttcgctgacgacgacaacacctatagtctggagctcttccaggagatgcgaaccacccgcaaggtctccgtctggcctgtgggcctggttggtgggcggcgctacgaacgtccgctggtggaaaacggcaaagttgttggctggtacaccggctggagagcagacaggccttttgccatcgacatggcaggatttgctgtaagtcttcaagtcattttgtccaatccaaaagctgtatttaagcgtcgtggatcccagccagggatgcaagaatctgactttctcaaacagataacaacagtcgaagaactggaaccgaaagcaaataactgcactaaggtattcattacacttgtgctgcccgacctcgagtgtcaccatgaagagtgcgctacccaagctatttccttccccttcaggttctcgtgtggcacactcggacagagaaggttaatctagccaacgagccaaagtaccacctggacacagtgaaaattgaggtataaattgaagcagcaactggtgcagtttgtccagccagtggatccatatggaagaggatgtttggagtttaggctacagagcattcaggtattgtttgttttacttcagtacagcagcctttcttgtcatctgatggacatctgtttaaatggagcttgtcagttaacataagctaattggatggttggtacaaaatgtatgttttgtcttcatttgttctgcatgttttctctacaacaactaaattggaagatttttttgtacagtgccgatactgcaagataccactcttg

SEQ ID NO: 361719 - DNA, 853 bp, Homo sapiens
ggggcagcccctgcccgcccgcctgcaccccttgtcgctctagcttgcgcgaacctgccgctcctccacgcccaggtagtgagccccgcggctccaggtctctgcagcgccctcggccccatggacagcgcacccatcaccactccctaagtgctggcgccgccgctgtccaagctgcgcactggggtccctcggctcgcccctctctggggtgtccgagaggccagggagcgtgcaccatgaagtccgcgcttttcacccgcttctttatcctcctgccctggatcctaattgtcatcatcatgctcgacgtggacacgcgcaggccagtgcccccgctcaccccgcgcccctacttctctccctacgcggtgggccgcgggggcgcccgactcccgctccgcaggggcggcccggctcacgggacccaaaagcgcaaccagtctcggccgcagccacagccggagccgcagctgcccaccatctatgccatcacgcccacctacagccgcccggtgcagaaagcggagctgacccgcctggccaacacgttccgccaggtggcgcagctgcactggatcctggtggaggacgcggcggcgcgcagcgagctggtgagccgcttcctggcgcgggccgggctgcccagcactcacctgcacgtgcccacgccgcggcgctacaagcggcccgggctgccgcgcgccactgagcagcgcaacgcgggcctcgcctggctgcgccagaggcaccagcaccagcgcgcgcagcccggcgtgctcttcttcgctgacgacgacaacacctatagtctggagctcttccaggaggtaaaggccagcctgccccgctg

SEQ ID NO: 361720 - DNA, 783 bp, Homo sapiens
aacgcgggcctcgcctggctgcgccagaggcaccagcaccagcgcgcgcagcccggcgtgctcttcttcgctgacgacgacaacacctatagtctggagctcttccaggagatgcgaaccacccgcaaggtctccgtctggcctgtgggcctggttggtgggcggcgctacgaacgtccgctggtggaaaacggcaaagttgttggctggtacaccggctggagagcagacaggccttttgccatcgacatggcaggatttgctgtaagtcttcaagtcattttgtccaatccaaaagctgtatttaagcgtcgtggatcccagccagggatgcaagaatctgactttctcaaacagataacaacagtcgaagaactggaaccgaaagcaaataactgcactaaggttctcgtgtggcacactcggacagagaaggttaatctagccaacgagccaaagtaccacctggacacagtgaaaattgaggtataaattgaagcagcaactggtgcagtttgtccagccagtggatccatatggaagaggatgtttggagtttaggctacagagcattcaggtattgtttgttttacttcagtacagcagcctttcttgtcatctgatggacatctgtttaaatggagcttgtcagttaacataagctaattggatggttggtacaaaatgtatgttttgtcttcatttgttctgcatgttttctctacaacaactaaattggaagatttttttgtacagtgccgatactgcaagataccactcttg

SEQ ID NO: 361721 - DNA, 686 bp, Homo sapiens
acaaaggatttgctgtaagtcttcaagtcattttgtccaatccaaaagctgtatttaagcgtcgtggatcccagccagggatgcaagaatctgactttctcaaacagataacaacagtcgaagaactggaaccgaaagcaaataactgcactaaggtattcattacacttgtgctgcccgacctcgagtgtcaccatgaagagtgcgctacccaagctatttccttccccttcaggttctcgtgtggcacactcggacagagaaggttaatctagccaacgagccaaagtaccacctggacacagtgaaaattgaggtataaattgaagcagcaactggtgcagtttgtccagccagtggatccatatggaagaggatgtttggagtttaggctacagagcattcaggtattgtttgttttacttcagtacagcagcctttcttgtcatctgatggacatctgtttaaatggagcttgtcagttaacataagctaattggatggttggtacaaaatgtatgttttgtcttcatttgttctgcatgttttctctacaacaactaaattggaagatttttttgtacagtgccgatactgcaagataccactcttgagtatatattttttctttttctccaatttgcccttataattggtagacttgaacaggttggtagacttgaaca

SEQ ID NO: 361722 - DNA, 3102 bp, Homo sapiens
ccccaggcccacactgaaagcatgtcgatccaggagaacatatcatccctgcagcttcggtcatgggtctctaagtcccaaagagacttagcaaagtccatcctgattggggctccaggagggccagcggggtatctgcggcgggccagtgtggcccaactgacccaggagctgggcactgccttcttccagcagcagcagctgccagctgctatggcagacaccttcctggaacacctctgcctactggacattgactccgagcccgtggctgctcgcagtaccagcatcattgccaccatcgggccagcatctcgctccgtggagcgcctcaaggagatgatcaaggccgggatgaacattgcgcgactcaacttctcccacggctcccacgagtaccatgctgagtccatcgccaacgtccgggaggcggtggagagctttgcaggttccccactcagctaccggcccgtggccatcgccctggacaccaagggaccggagatccgcactgggatcctgcaggggggtccagagtcggaagtggagctggtgaagggctcccaggtgctggtgactgtggaccccgcgttccggacgcgggggaacgcgaacaccgtgtgggtggactaccccaatattgtccgggtcgtgccggtggggggccgcatctacattgacgacgggctcatctccctagtggtccagaaaatcggcccagagggactggtgacccaagtggagaacggcggcgtcctgggcagccggaagggcgtgaacttgccaggggcccaggtggacttgcccgggctgtccgagcaggacgtccgagacctgcgcttcggggtggagcatggggtggacatcgtctttgcctcctttgtgcggaaagccagcgacgtggctgccgtcagggctgctctgggtccggaaggacacggcatcaagatcatcagcaaaattgagaaccacgaaggcgtgaagaggtttgatgaaatcctggaggtgagcgacggcatcatggtggcacggggggacctaggcatcgagatcccagcagagaaggttttcctggctcagaagatgatgattgggcgctgcaacttggcgggcaagcctgttgtctgtgccacacagatgctggagagcatgattaccaagccccggccaacgagggcagagacaagcgatgtcgccaatgctgtgctggatggggctgactgcatcatgctgtcaggggagactgccaagggcaacttccctgtggaagcggtgaagatgcagcatgcgattgcccgggaggcagaggccgcagtgtaccaccggcagctgtttgaggagctacgtcgggcagcgccactaagccgtgatcccactgaggtcaccgccattggtgctgtggaggctgccttcaagtgctgtgctgctgccatcattgtgctgaccacaactggccgctcagcccagcttctgtctcggtaccgacctcgggcagcagtcattgctgtcacccgctctgcccaggctgcccgccaggtccacttatgccgaggagtcttccccttgctttaccgtgaacctccagaagccatctgggcagatgatgtagatcgccgggtgcaatttggcattgaaagtggaaagctccgtggcttcctccgtgttggagacctggtgattgtggtgacaggctggcgacctggctccggctacaccaacatcatgcgggtgctaagcatatcctgagacgcccctccctcctctggcccagcctacccttgtaccccatcccttcctccccagtctacgttctccagcccacacccctccaaagccccacctttaagtcctctcttctctattcctgaccctccctacctgaggcctatctgagactataactgtcatctagccccttcgaggttgccccttccccatctccatttcacacaggtcctgaaagtctgtgtccaattatgcactggccacccaacagcaccaattgtacattccctgcatccaatctgctcagcaggccctaagatgccttgagtctttaatcccagtttggctggttaattccataaccccaggcatcccatcccttggggtgggggagaggggagacagggcaatcttgtccacagtctcccattctcatatgtagccctcatgataatctgggcatctcgtgccagggcaggctaccccttcatggtgactaacagttacatgaaagtccacgcttttgggaaaactgggtgggatggatgctggggagaagtgagggctgggcagctgattttgtcactgtcttcacaacctccgtgctgggcttgtagaccactgtcctggctgctctcatgcctgcctgataccctgcttggtcaaatccccggctgcttccttctgcacccagaaattccttcccactcatgttgttcccacacacaaaccaagagccaaaaatgagtgtgtctattttatatttaaacccagctgtttggaagcaattataaaacttctcccacacaccaagaaccccagaactccccacccagaaggaaaggagacttagggtcctggtcccacagtctttaatgctgtagagtaggagaggggacaggcagagtgagggtggtaaaggactactcttgtccctgagaaggcagaggtgctggctggcctgcccttccccaggcttggataccttgggcctttcccttattcctgcaccaacagcaaactcagaaggaaaaaacaaaacaaaactctaaaggtaaacgcggtccttctccctctctcatgtggctcctcctgcccctacctgggagaaggttcaagtattgcgctgatgggtttgggcaaggaccacagaggctggcatggagaggccctgcctcctcctactcctcctgtctccttacctgaaaaggaggggagggatggataaaggaatgggtaaacaaaattaattggtaacacataaagttagtaaatgaataaatacaattaaataaatgaataaataaacaagcgaagaaaaaaatatcacacaaggattcagccatttgcccctccaccgggggggatctaggctgg

SEQ ID NO: 361723 - DNA, 2853 bp, Homo sapiens
ccccaggcccacactgaaagcatgtcgatccaggagaacatatcatccctgcagcttcggtcatgggtctctaagtcccaaagagacttagcaaagtccatcctgattggggctccaggagggccagcggggtatctgcggcgggccagtgtggcccaactgacccaggagctgggcactgccttcttccagcagcagcagctgccagctgctatggcagacaccttcctggaacacctctgcctactggacattgactccgagcccgtggctgctcgcagtaccagcatcattgccaccatcgggccagcatctcgctccgtggagcgcctcaaggagatgatcaaggccgggatgaacattgcgcgactcaacttctcccacggctcccacgagtaccatgctgagtccatcgccaacgtccgggaggcggtggagagctttgcaggttccccactcagctaccggcccgtggccatcgccctggacaccaagggaccggagatccgcactgggatcctgcaggggggtccagagtcggaagtggagctggtgaagggctcccaggtgctggtgactgtggaccccgcgttccggacgcgggggaacgcgaacaccgtgtgggtggactaccccaatattgtccgggtcgtgccggtggggggccgcatctacattgacgacgggctcatctccctagtggtccagaaaatcggcccagagggactggtgacccaagtggagaacggcggcgtcctgggcagccggaagggcgtgaacttgccaggggcccaggtggacttgcccgggctgtccgagcaggacgtccgagacctgcgcttcggggtggagcatggggtggacatcgtctttgcctcctttgtgcggaaagccagcgacgtggctgccgtcagggctgctctgggtccggaaggacacggcatcaagatcatcagcaaaattgagaaccacgaaggcgtgaagaggtttgatgaaatcctggaggtgagcgacggcatcatggtggcacggggggacctaggcatcgagatcccagcagagaaggttttcctggctcagaagatgatgattgggcgctgcaacttggcgggcaagcctgttgtctgtgccacacagatgctggagagcatgattaccaagccccggccaacgagggcagagacaagcgatgtcgccaatgctgtgctggatggggctgactgcatcatgctgtcaggggagactgccaagggcaacttccctgtggaagcggtgaagatgcagcatgcgattgcccgggaggcagaggccgcagtgtaccaccggcagctgtttgaggagctacgtcgggcagcgccactaagccgtgatcccactgaggtcaccgccattggtgctgtggaggctgccttcaagtgctgtgctgctgccatcattgtgctgaccacaactggccgctcagcccagcttctgtctcggtaccgacctcgggcagcagtcattgctgtcacccgctctgcccaggctgcccgccaggtccacttatgccgaggagtcttccccttgctttaccgtgaacctccagaagccatctgggcagatgatgtagatcgccgggtgcaatttggcattgaaagtggaaagctccgtggcttcctccgtgttggagacctggtgattgtggtgacaggctggcgacctggctccggctacaccaacatcatgcgggtgctaagcatatcctgagacgcccctccctcctctggcccagcctacccttgtaccccatcccttcctccccagtctacgttctccagcccacacccctccaaagccccacctttaagtcctctcttctctattcctgaccctccctacctgaggcctatctgagactataactgtcatctagccccttcgaggttgccccttccccatctccatttcacacaggtcctgaaagtctgtgtccaattatgcactggccacccaacagcaccaattgtacattccctgcatccaatctgctcagcaggcccctcatgataatctgggcatctcgtgccagggcaggctaccccttcatggtgactaacagttacatgaaagtccacgcttttgggaaaactgggtgggatggatgctggggagaagtgagggctgggcagctgattttgtcactgtcttcacaacctccgtgctgggcttgtagaccactgtcctggctgctctcatgcctgcctgataccctgcttggtcaaatccccggctgcttccttctgcacccagaaattccttcccactcatgttgttcccacacacaaaccaagagccaaaaatgagtgtgtctattttatatttaaacccagctgtttggaagcaattataaaacttctcccacacaccaagaaccccagaactccccacccagaaggaaaggagacttagggtcctggtcccacagtctttaatgctgtagagtaggagaggggacaggcagagtgagggtggtaaaggactactcttgtccctgagaaggcagaggtgctggctggcctgcccttcctcctgcccctacctgggagaaggttcaagtattgcgctgatgggtttgggcaaggaccacagaggctggcatggagaggccctgcctcctcctactcctcctgtctccttacctgaaaaggaggggagggatggataaaggaatgggtaaacaaaattaattggtaacacataaagttagtaaatgaataaatacaattaaataaatgaataaataaacaagcgaagaaaaaaatatcacacaaggattcagccatttgcccctccaccgggggggatctaggctgg

SEQ ID NO: 361724 - DNA, 3056 bp, Homo sapiens
tgcctctgacaacccaacagtgtggagcagacccacagagagggagacccagagaggtgtgcagtggcatggaagggccagcggggtatctgcggcgggccagtgtggcccaactgacccaggagctgggcactgccttcttccagcagcagcagctgccagctgctatggcagacaccttcctggaacacctctgcctactggacattgactccgagcccgtggctgctcgcagtaccagcatcattgccaccatcgggccagcatctcgctccgtggagcgcctcaaggagatgatcaaggccgggatgaacattgcgcgactcaacttctcccacggctcccacgagtaccatgctgagtccatcgccaacgtccgggaggcggtggagagctttgcaggttccccactcagctaccggcccgtggccatcgccctggacaccaagggaccggagatccgcactgggatcctgcaggggggtccagagtcggaagtggagctggtgaagggctcccaggtgctggtgactgtggaccccgcgttccggacgcgggggaacgcgaacaccgtgtgggtggactaccccaatattgtccgggtcgtgccggtggggggccgcatctacattgacgacgggctcatctccctagtggtccagaaaatcggcccagagggactggtgacccaagtggagaacggcggcgtcctgggcagccggaagggcgtgaacttgccaggggcccaggtggacttgcccgggctgtccgagcaggacgtccgagacctgcgcttcggggtggagcatggggtggacatcgtctttgcctcctttgtgcggaaagccagcgacgtggctgccgtcagggctgctctgggtccggaaggacacggcatcaagatcatcagcaaaattgagaaccacgaaggcgtgaagaggtttgatgaaatcctggaggtgagcgacggcatcatggtggcacggggggacctaggcatcgagatcccagcagagaaggttttcctggctcagaagatgatgattgggcgctgcaacttggcgggcaagcctgttgtctgtgccacacagatgctggagagcatgattaccaagccccggccaacgagggcagagacaagcgatgtcgccaatgctgtgctggatggggctgactgcatcatgctgtcaggggagactgccaagggcaacttccctgtggaagcggtgaagatgcagcatgcgattgcccgggaggcagaggccgcagtgtaccaccggcagctgtttgaggagctacgtcgggcagcgccactaagccgtgatcccactgaggtcaccgccattggtgctgtggaggctgccttcaagtgctgtgctgctgccatcattgtgctgaccacaactggccgctcagcccagcttctgtctcggtaccgacctcgggcagcagtcattgctgtcacccgctctgcccaggctgcccgccaggtccacttatgccgaggagtcttccccttgctttaccgtgaacctccagaagccatctgggcagatgatgtagatcgccgggtgcaatttggcattgaaagtggaaagctccgtggcttcctccgtgttggagacctggtgattgtggtgacaggctggcgacctggctccggctacaccaacatcatgcgggtgctaagcatatcctgagacgcccctccctcctctggcccagcctacccttgtaccccatcccttcctccccagtctacgttctccagcccacacccctccaaagccccacctttaagtcctctcttctctattcctgaccctccctacctgaggcctatctgagactataactgtcatctagccccttcgaggttgccccttccccatctccatttcacacaggtcctgaaagtctgtgtccaattatgcactggccacccaacagcaccaattgtacattccctgcatccaatctgctcagcaggccctaagatgccttgagtctttaatcccagtttggctggttaattccataaccccaggcatcccatcccttggggtgggggagaggggagacagggcaatcttgtccacagtctcccattctcatatgtagccctcatgataatctgggcatctcgtgccagggcaggctaccccttcatggtgactaacagttacatgaaagtccacgcttttgggaaaactgggtgggatggatgctggggagaagtgagggctgggcagctgattttgtcactgtcttcacaacctccgtgctgggcttgtagaccactgtcctggctgctctcatgcctgcctgataccctgcttggtcaaatccccggctgcttccttctgcacccagaaattccttcccactcatgttgttcccacacacaaaccaagagccaaaaatgagtgtgtctattttatatttaaacccagctgtttggaagcaattataaaacttctcccacacaccaagaaccccagaactccccacccagaaggaaaggagacttagggtcctggtcccacagtctttaatgctgtagagtaggagaggggacaggcagagtgagggtggtaaaggactactcttgtccctgagaaggcagaggtgctggctggcctgcccttccccaggcttggataccttgggcctttcccttattcctgcaccaacagcaaactcagaaggaaaaaacaaaacaaaactctaaaggtaaacgcggtccttctccctctctcatgtggctcctcctgcccctacctgggagaaggttcaagtattgcgctgatgggtttgggcaaggaccacagaggctggcatggagaggccctgcctcctcctactcctcctgtctccttacctgaaaaggaggggagggatggataaaggaatgggtaaacaaaattaattggtaacacataaagttagtaaatgaataaatacaattaaataaatgaataaataaacaagcgaagaaaaaaatatcacacaaggattcagccatttgcccctccaccgggggggatctaggctgg

SEQ ID NO: 361725 - DNA, 1281 bp, Homo sapiens
tgcctctgacaacccaacagtgtggagcagacccacagagagggagaccctccctacctgaggcctatctgagactataactgtcatctagccccttcgaggttgccccttccccatctccatttcacacaggtcctgaaagtctgtgtccaattatgcactggccacccaacagcaccaattgtacattccctgcatccaatctgctcagcaggccctaagatgccttgagtctttaatcccagtttggctggttaattccataaccccaggcatcccatcccttggggtgggggagaggggagacagggcaatcttgtccacagtctcccattctcatatgtagccctcatgataatctgggcatctcgtgccagggcaggctaccccttcatggtgactaacagttacatgaaagtccacgcttttgggaaaactgggtgggatggatgctggggagaagtgagggctgggcagctgattttgtcactgtcttcacaacctccgtgctgggcttgtagaccactgtcctggctgctctcatgcctgcctgataccctgcttggtcaaatccccggctgcttccttctgcacccagaaattccttcccactcatgttgttcccacacacaaaccaagagccaaaaatgagtgtgtctattttatatttaaacccagctgtttggaagcaattataaaacttctcccacacaccaagaaccccagaactccccacccagaaggaaaggagacttagggtcctggtcccacagtctttaatgctgtagagtaggagaggggacaggcagagtgagggtggtaaaggactactcttgtccctgagaaggcagaggtgctggctggcctgcccttccccaggcttggataccttgggcctttcccttattcctgcaccaacagcaaactcagaaggaaaaaacaaaacaaaactctaaaggtaaacgcggtccttctccctctctcatgtggctcctcctgcccctacctgggagaaggttcaagtattgcgctgatgggtttgggcaaggaccacagaggctggcatggagaggccctgcctcctcctactcctcctgtctccttacctgaaaaggaggggagggatggataaaggaatgggtaaacaaaattaattggtaacacataaagttagtaaatgaataaatacaattaaataaatgaataaataaacaagcgaagaaaaaaatatcacacaaggattcagccatttgcccctccaccgggggggatctaggctgg

SEQ ID NO: 361726 - DNA, 2972 bp, Homo sapiens
ccccaggcccacactgaaagcatgtcgatccaggagaacatatcatccctgcagcttcggtcatgggtctctaagtcccaaagagacttagcaaagtccatcctgattggggctccaggagggccagcggggtatctgcggcgggccagtgtggcccaactgacccaggagctgggcactgccttcttccagcagcagcagctgccagctgctatggcagacaccttcctggaacacctctgcctactggacattgactccgagcccgtggctgctcgcagtaccagcatcattgccaccatcgggccagcatctcgctccgtggagcgcctcaaggagatgatcaaggccgggatgaacattgcgcgactcaacttctcccacggctcccacgagtaccatgctgagtccatcgccaacgtccgggaggcggtggagagctttgcaggttccccactcagctaccggcccgtggccatcgccctggacaccaagggaccggagatccgcactgggatcctgcaggggggtccagagtcggaagtggagctggtgaagggctcccaggtgctggtgactgtggaccccgcgttccggacgcgggggaacgcgaacaccgtgtgggtggactaccccaatattgtccgggtcgtgccggtggggggccgcatctacattgacgacgggctcatctccctagtggtccagaaaatcggcccagagggactggtgacccaagtggagaacggcggcgtcctgggcagccggaagggcgtgaacttgccaggggcccaggtggacttgcccgggctgtccgagcaggacgtccgagacctgcgcttcggggtggagcatggggtggacatcgtctttgcctcctttgtgcggaaagccagcgacgtggctgccgtcagggctgctctgggtccggaaggacacggcatcaagatcatcagcaaaattgagaaccacgaaggcgtgaagaggtttgatgaaatcctggaggtgagcgacggcatcatggtggcacggggggacctaggcatcgagatcccagcagagaaggttttcctggctcagaagatgatgattgggcgctgcaacttggcgggcaagcctgttgtctgtgccacacagatgctggagagcatgattaccaagccccggccaacgagggcagagacaagcgatgtcgccaatgctgtgctggatggggctgactgcatcatgctgtcaggggagactgccaagggcaacttccctgtggaagcggtgaagatgcagcatgcgattgcccgggaggcagaggccgcagtgtaccaccggcagctgtttgaggagctacgtcgggcagcgccactaagccgtgatcccactgaggtcaccgccattggtgctgtggaggctgccttcaagtgctgtgctgctgccatcattgtgctgaccacaactggccgctcagcccagcttctgtctcggtaccgacctcgggcagcagtcattgctgtcacccgctctgcccaggctgcccgccaggtccacttatgccgaggagtcttccccttgctttaccgtgaacctccagaagccatctgggcagatgatgtagatcgccgggtgcaatttggcattgaaagtggaaagctccgtggcttcctccgtgttggagacctggtgattgtggtgacaggctggcgacctggctccggctacaccaacatcatgcgggtgctaagcatatcctgagacgcccctccctcctctggcccagcctacccttgtaccccatcccttcctccccagtctacgttctccagcccacacccctccaaagccccacctttaagtcctctcttctctattcctgaccctccctacctgaggcctatctgagactataactgtcatctagccccttcgaggttgccccttccccatctccatttcacacaggtcctgaaagtctgtgtccaattatgcactggccacccaacagcaccaattgtacattccctgcatccaatctgctcagcaggcccctcatgataatctgggcatctcgtgccagggcaggctaccccttcatggtgactaacagttacatgaaagtccacgcttttgggaaaactgggtgggatggatgctggggagaagtgagggctgggcagctgattttgtcactgtcttcacaacctccgtgctgggcttgtagaccactgtcctggctgctctcatgcctgcctgataccctgcttggtcaaatccccggctgcttccttctgcacccagaaattccttcccactcatgttgttcccacacacaaaccaagagccaaaaatgagtgtgtctattttatatttaaacccagctgtttggaagcaattataaaacttctcccacacaccaagaaccccagaactccccacccagaaggaaaggagacttagggtcctggtcccacagtctttaatgctgtagagtaggagaggggacaggcagagtgagggtggtaaaggactactcttgtccctgagaaggcagaggtgctggctggcctgcccttccccaggcttggataccttgggcctttcccttattcctgcaccaacagcaaactcagaaggaaaaaacaaaacaaaactctaaaggtaaacgcggtccttctccctctctcatgtggctcctcctgcccctacctgggagaaggttcaagtattgcgctgatgggtttgggcaaggaccacagaggctggcatggagaggccctgcctcctcctactcctcctgtctccttacctgaaaaggaggggagggatggataaaggaatgggtaaacaaaattaattggtaacacataaagttagtaaatgaataaatacaattaaataaatgaataaataaacaagcgaagaaaaaaatatcacacaaggattcagccatttgcccctccaccgggggggatctaggctgg

SEQ ID NO: 361727 - DNA, 3047 bp, Homo sapiens
ccccaggcccacactgaaagcatgtcgatccaggagaacatatcatccctgcagcttcggtcatgggtctctaagtcccaaagagacttagcaaagtccatcctgattggggctccaggagggccagcggggtatctgcggcgggccagtgtggcccaactgacccaggagctgggcactgccttcttccagcagcagcagctgccagctgctatggcagacaccttcctggaacacctctgcctactggacattgactccgagcccgtggctgctcgcagtaccagcatcattgccaccatcgggccagcatctcgctccgtggagcgcctcaaggagatgatcaaggccgggatgaacattgcgcgactcaacttctcccacggctcccacgagtaccatgctgagtccatcgccaacgtccgggaggcggtggagagctttgcaggttccccactcagctaccggcccgtggccatcgccctggacaccaagggaccggagatccgcactgggatcctgcaggggggtccagagtcggaagtggagctggtgaagggctcccaggtgctggtgactgtggaccccgcgttccggacgcgggggaacgcgaacaccgtgtgggtggactaccccaatattgtccgggtcgtgccggtggggggccgcatctacattgacgacgggctcatctccctagtggtccagaaaatcggcccagagggactggtgacccaagtggagaacggcggcgtcctgggcagccggaagggcgtgaacttgccaggggcccaggtggacttgcccgggctgtccgagcaggacgtccgagacctgcgcttcggggtggagcatggggtggacatcgtctttgcctcctttgtgcggaaagccagcgacgtggctgccgtcagggctgctctgggtccggaaggacacggcatcaagatcatcacgacggcatcatggtggcacggggggacctaggcatcgagatcccagcagagaaggttttcctggctcagaagatgatgattgggcgctgcaacttggcgggcaagcctgttgtctgtgccacacagatgctggagagcatgattaccaagccccggccaacgagggcagagacaagcgatgtcgccaatgctgtgctggatggggctgactgcatcatgctgtcaggggagactgccaagggcaacttccctgtggaagcggtgaagatgcagcatgcgattgcccgggaggcagaggccgcagtgtaccaccggcagctgtttgaggagctacgtcgggcagcgccactaagccgtgatcccactgaggtcaccgccattggtgctgtggaggctgccttcaagtgctgtgctgctgccatcattgtgctgaccacaactggccgctcagcccagcttctgtctcggtaccgacctcgggcagcagtcattgctgtcacccgctctgcccaggctgcccgccaggtccacttatgccgaggagtcttccccttgctttaccgtgaacctccagaagccatctgggcagatgatgtagatcgccgggtgcaatttggcattgaaagtggaaagctccgtggcttcctccgtgttggagacctggtgattgtggtgacaggctggcgacctggctccggctacaccaacatcatgcgggtgctaagcatatcctgagacgcccctccctcctctggcccagcctacccttgtaccccatcccttcctccccagtctacgttctccagcccacacccctccaaagccccacctttaagtcctctcttctctattcctgaccctccctacctgaggcctatctgagactataactgtcatctagccccttcgaggttgccccttccccatctccatttcacacaggtcctgaaagtctgtgtccaattatgcactggccacccaacagcaccaattgtacattccctgcatccaatctgctcagcaggccctaagatgccttgagtctttaatcccagtttggctggttaattccataaccccaggcatcccatcccttggggtgggggagaggggagacagggcaatcttgtccacagtctcccattctcatatgtagccctcatgataatctgggcatctcgtgccagggcaggctaccccttcatggtgactaacagttacatgaaagtccacgcttttgggaaaactgggtgggatggatgctggggagaagtgagggctgggcagctgattttgtcactgtcttcacaacctccgtgctgggcttgtagaccactgtcctggctgctctcatgcctgcctgataccctgcttggtcaaatccccggctgcttccttctgcacccagaaattccttcccactcatgttgttcccacacacaaaccaagagccaaaaatgagtgtgtctattttatatttaaacccagctgtttggaagcaattataaaacttctcccacacaccaagaaccccagaactccccacccagaaggaaaggagacttagggtcctggtcccacagtctttaatgctgtagagtaggagaggggacaggcagagtgagggtggtaaaggactactcttgtccctgagaaggcagaggtgctggctggcctgcccttccccaggcttggataccttgggcctttcccttattcctgcaccaacagcaaactcagaaggaaaaaacaaaacaaaactctaaaggtaaacgcggtccttctccctctctcatgtggctcctcctgcccctacctgggagaaggttcaagtattgcgctgatgggtttgggcaaggaccacagaggctggcatggagaggccctgcctcctcctactcctcctgtctccttacctgaaaaggaggggagggatggataaaggaatgggtaaacaaaattaattggtaacacataaagttagtaaatgaataaatacaattaaataaatgaataaataaacaagcgaagaaaaaaatatcacacaaggattcagccatttgcccctccaccgggggggatctaggctgg

SEQ ID NO: 361728 - DNA, 156 bp, Homo sapiens
gacaatgaatagacatgtgccttctcaagctaagtaacaagaataactctaaagttcacattacgaaagtattatcagaatccaataagatactactgtccaatcatagttaaggcttcatgattgatgttttaataagtaacttactcatagaac

SEQ ID NO: 361729 - DNA, 3021 bp, Homo sapiens
ccgcggccgtggccttcgggagcggggcgttgatgctggggatgttcgtgctgcagctcggcgtcttgtccacctttttgtccgagcctgtggtcaaggcgctgaccagcggggccgcgctgcacgtgctcttgtcccagctgccgagcctcttggggttgtccctcccgcgccagatcggctgcttctctctcttcaagacgctggcctccttgctgactgcgctgcctcggagcagtccggccgaactgaccatctccgcgctcagcctggcgctgctcgtgccggtcaaggaattgaacgtgagattccgagaccggctacccacgccgatcccgggggaagtcgtcttggtgcttctggcctccgtgctctgcttcacctcttctgtggacacaagataccaagtccagatagtggggctgttgcctggagggtaagagaatgaaaagatgccagctttctcttctcccacctctcccacccaacactccctcttatctccaccccccattttctctgccttccttatctcactgaagcacctaacccctcctcaccatggatccctccctctccagatttccccaacccctcctccccaacctggctgagctgcccaggattctggctgactcgctgcccattgcactggttagttttgcggtgtctgcctccctggcctccatccatgcagacaagtatagctacactattgactccaaccaggtgggactctgactgtggaccccaaccctctcatttgacttcccaccatgcctttgtctctcccacttcatctcactgtatccctccaggagttcctggcacatggtgcctccaacctcatctcctccctcttctcttgctttcccaactcggctacgctggccaccaccaatctactggtggatgctggtgggaaaacacaggtaagagggcatccttggatgaggagaaaggatgggccatccaggcaaggtggcggtggtggagaaacaggtggaagatggctagaatcccaggtggcacctatatagagaagactggggatctgtgagaaagggtgactgaggggatggaattatagataggagagatggaagataacaatgttccagtaagacctttgtaggctctaagcgctgaaaaagtttatggtgccccaggtgtggttcaaaataaaaacacaaaactataaaataaacttaagagataaaattcttatttttttcacacaatgacattgtcttttaaaaggaatatcacatatcaaagtctccccctaatatttttggtttcccttactttgctggtgccctaaacacatataccctgcttatagggtaacccaacagtggcttttaaggtggaggtgggctacaaaactggggaacttgaacaatggacatctacaaggagactggtgaataatgggcatttaattaattggggggagcgggagggttagatgtgaatggcagaatattaagaagggggttgtgtggaaggagatttgggagaagggagacttccgaggaagattaggcagagtgggcaggaagaccagctctcatgtgggggtgggaggctctcttccttttttgctcctgttcctccttttctctagctggcaggcctcttctcctgcacagtggtcctgtcggtgctgctgtggctggggcccttcttttactatctgcccaaggtaatgagcagaggaggcatgagcatggctgggaggggtagctgtattccaggacatcgaggtagtcagcccacctcctctgcctcaaggctgtcctggcttgcatcaacatctccagcatgcgccaggtgttctgccagatgcaggaacttccacaactatggcacatcagccgagtggactttgtgagaaatgccattacccccagattgccccctctcatcttgttagcatccccagcctctgccctgaaccaaacctaattgtcctggtcttaagttctgcaacccacccactcccccagcaaacataactcctagtatgctttactcacaggcaagggaaaggatggggtttgaacccctttggcctgaatatttgtaacttcccaactggtgcgggtcattacatttggtgtgtgtcccattgaatcaaccctgttgtttccttctgtcatgctttccacttcttcctggatcatctctccccatcacttgccttggtagtcactgccctggatctctttacccagcagtgatggcctggcttttcttttgggcaatccacccctatccctatcctgcaggctgtgtggatggtcacctgggtggcagtagtgaccctgagtgtggatttgggcctggctgtgggtgtggtcttctccatgatgactgtggtctgccgcacccggagctcctccaggtcccggggctctgcatcctgagctatccaacaccactgtactttgggacccgtgggcagtttcgctgcaacctggagtggcacctggggctcggagaaggagaaaaggagacttcaaagccagatggcccaatggttgcagttgctgagcctgtcagggtggtggtcctagacttcagtggtgtcacctttgcagatgctgctggggccagagaagtggtgcagctggccagccgatgtcgagatgctaggatccgcctcctcctggctcagtgtaatgccttggtgcaggggacactgacccgggtaggactcctggacagggtgactccagatcagctgtttgtgagtgtgcaggatgcagctgcttatgccctggggagcctggtaaggggcagtagcaccaggagcgggagccaggaggcactgggctgcggcaagtgaggcaggggagctcactgacccaaagatttgcaccgtgtgggtctgacctcatcatgtggagtgcagagggccctgatgacatgtgtgtgatgaggaccatgacccttgaacccccttacctaacgtaactaataaaatgaagctgagagctttggaatccatgaagt

SEQ ID NO: 361730 - DNA, 3147 bp, Homo sapiens
ctctcatggtcagccccttctagcttctgccagggaccccatctcttcccatgccttcattttgctctctttttcaggtgcttctggcctccgtgctctgcttcacctcttctgtggacacaagataccaagtccagatagtggggctgttgcctggagggtaagagaatgaaaagatgccagctttctcttctcccacctctcccacccaacactccctcttatctccaccccccattttctctgccttccttatctcactgaagcacctaacccctcctcaccatggatccctccctctccagatttccccaacccctcctccccaacctggctgagctgcccaggattctggctgactcgctgcccattgcactggttagttttgcggtgtctgcctccctggcctccatccatgcagacaagtatagctacactattgactccaaccaggtgggactctgactgtggaccccaaccctctcatttgacttcccaccatgcctttgtctctcccacttcatctcactgtatccctccaggagttcctggcacatggtgcctccaacctcatctcctccctcttctcttgctttcccaactcggctacgctggccaccaccaatctactggtggatgctggtgggaaaacacaggtaagagggcatccttggatgaggagaaaggatgggccatccaggcaaggtggcggtggtggagaaacaggtggaagatggctagaatcccaggtggcacctatatagagaagactggggatctgtgagaaagggtgactgaggggatggaattatagataggagagatggaagataacaatgttccagtaagacctttgtaggctctaagcgctgaaaaagtttatggtgccccaggtgtggttcaaaataaaaacacaaaactataaaataaacttaagagataaaattcttatttttttcacacaatgacattgtcttttaaaaggaatatcacatatcaaagtctccccctaatatttttggtttcccttactttgctggtgccctaaacacatataccctgcttatagggtaacccaacagtggcttttaaggtggaggtgggctacaaaactggggaacttgaacaatggacatctacaaggagactggtgaataatgggcatttaattaattggggggagcgggagggttagatgtgaatggcagaatattaagaagggggttgtgtggaaggagatttgggagaagggagacttccgaggaagattaggcagagtgggcaggaagaccagctctcatgtgggggtgggaggctctcttccttttttgctcctgttcctccttttctctagctggcaggcctcttctcctgcacagtggtcctgtcggtgctgctgtggctggggcccttcttttactatctgcccaaggtaatgagcagaggaggcatgagcatggctgggaggggtagctgtattccaggacatcgaggtagtcagcccacctcctctgcctcaaggctgtcctggcttgcatcaacatctccagcatgcgccaggtgttctgccagatgcaggaacttccacaactatggcacatcagccgagtggactttgtgagaaatgccattacccccagattgccccctctcatcttgttagcatccccagcctctgccctgaaccaaacctaattgtcctggtcttaagttctgcaacccacccactcccccagcaaacataactcctagtatgctttactcacaggcaagggaaaggatggggtttgaacccctttggcctgaatatttgtaacttcccaactggtgcgggtcattacatttggtgtgtgtcccattgaatcaaccctgttgtttccttctgtcatgctttccacttcttcctggatcatctctccccatcacttgccttggtagtcactgccctggatctctttacccagcagtgatggcctggcttttcttttgggcaatccacccctatccctatcctgcaggctgtgtggatggtcacctgggtggcagtagtgaccctgagtgtggatttgggcctggctgtgggtgtggtcttctccatgatgactgtggtctgccgcacccggaggtgggcatagagatgagtggagttgaggtcggggcaggggaagagaatgaggtgcttggggtgactctccagccaggccaggctaagctggaaatctggccccaccttcttccctagggtgtagtgcctggcacttggacaggctgaggggacagagctctacagaccactcagaggaagccccagggtgggtgggctgcagccaaagaaggaagggaagattagccccagacatttctctgatcctttgacctcttagctcctccaggtcccggggctctgcatcctgagctatccaacaccactgtactttgggacccgtgggcagtttcgctgcaacctggagtggcacctggggctcggagaaggagaaaagaaggtgaaggagcttggtttaggagggatgtggatcctcagggagtgggaggcaggtgggtgttctgagggggatccttgtgctcaaggggtgcatgttcatgctgtgtttcgggagtggtgactgcccttctttacttataggagacttcaaagccagatggcccaatggttgcagttgctgagcctgtcagggtggtggtcctagacttcagtggtgtcacctttgcagatgctgctggggccagagaagtggtgcagctggccagccgatgtcgagatgctaggatccgcctcctcctggctcagtgtaatgccttggtgcaggggacactgacccgggtaggactcctggacagggtgactccagatcagctgtttgtgagtgtgcaggatgcagctgcttatgccctggggagcctggtaaggggcagtagcaccaggagcgggagccaggaggcactgggctgcggcaagtgaggcaggggagctcactgacccaaagatttgcaccgtgtgggtctgacctcatcatgtggagtgcagagggccctgatgacatgtgtgtgatgaggaccatgacccttgaacccccttacctaacgtaactaataaaatgaagctgagagctttggaatccatgaagt

SEQ ID NO: 361731 - DNA, 3264 bp, Homo sapiens
ctctcatggtcagccccttctagcttctgccagggaccccatctcttcccatgccttcattttgctctctttttcaggtgcttctggcctccgtgctctgcttcacctcttctgtggacacaagataccaagtccagatagtggggctgttgcctggagggtaagagaatgaaaagatgccagctttctcttctcccacctctcccacccaacactccctcttatctccaccccccattttctctgccttccttatctcactgaagcacctaacccctcctcaccatggatccctccctctccagatttccccaacccctcctccccaacctggctgagctgcccaggattctggctgactcgctgcccattgcactggttagttttgcggtgtctgcctccctggcctccatccatgcagacaagtatagctacactattgactccaaccaggtgggactctgactgtggaccccaaccctctcatttgacttcccaccatgcctttgtctctcccacttcatctcactgtatccctccaggagttcctggcacatggtgcctccaacctcatctcctccctcttctcttgctttcccaactcggctacgctggccaccaccaatctactggtggatgctggtgggaaaacacaggtaagagggcatccttggatgaggagaaaggatgggccatccaggcaaggtggcggtggtggagaaacaggtggaagatggctagaatcccaggtggcacctatatagagaagactggggatctgtgagaaagggtgactgaggggatggaattatagataggagagatggaagataacaatgttccagtaagacctttgtaggctctaagcgctgaaaaagtttatggtgccccaggtgtggttcaaaataaaaacacaaaactataaaataaacttaagagataaaattcttatttttttcacacaatgacattgtcttttaaaaggaatatcacatatcaaagtctccccctaatatttttggtttcccttactttgctggtgccctaaacacatataccctgcttatagggtaacccaacagtggcttttaaggtggaggtgggctacaaaactggggaacttgaacaatggacatctacaaggagactggtgaataatgggcatttaattaattggggggagcgggagggttagatgtgaatggcagaatattaagaagggggttgtgtggaaggagatttgggagaagggagacttccgaggaagattaggcagagtgggcaggaagaccagctctcatgtgggggtgggaggctctcttccttttttgctcctgttcctccttttctctagctggcaggcctcttctcctgcacagtggtcctgtcggtgctgctgtggctggggcccttcttttactatctgcccaaggtaatgagcagaggaggcatgagcatggctgggaggggtagctgtattccaggacatcgaggtagtcagcccacctcctctgcctcaaggctgtcctggcttgcatcaacatctccagcatgcgccaggtgttctgccagatgcaggaacttccacaactatggcacatcagccgagtggactttgtgagaaatgccattacccccagattgccccctctcatcttgttagcatccccagcctctgccctgaaccaaacctaattgtcctggtcttaagttctgcaacccacccactcccccagcaaacataactcctagtatgctttactcacaggcaagggaaaggatggggtttgaacccctttggcctgaatatttgtaacttcccaactggtgcgggtcattacatttggtgtgtgtcccattgaatcaaccctgttgtttccttctgtcatgctttccacttcttcctggatcatctctccccatcacttgccttggtagtcactgccctggatctctttacccagcagtgatggcctggcttttcttttgggcaatccacccctatccctatcctgcaggctgtgtggatggtcacctgggtggcagtagtgaccctgagtgtggatttgggcctggctgtgggtgtggtcttctccatgatgactgtggtctgccgcacccggaggtgggcatagagatgagtggagttgaggtcggggcaggggaagagaatgaggtgcttggggtgactctccagccaggccaggctaagctggaaatctggccccaccttcttccctagggtgtagtgcctggcacttggacaggctgaggggacagagctctacagaccactcagaggaagccccagggtgggtgggctgcagccaaagaaggaagggaagattagccccagacatttctctgatcctttgacctcttagctcctccaggtcccggggctctgcatcctgagctatccaacaccactgtactttgggacccgtgggcagtttcgctgcaacctggagtggcacctggggctcggagaaggagaaaagaaggtgaaggagcttggtttaggagggatgtggatcctcagggagtgggaggcaggtgggtgttctgagggggatccttgtgctcaaggggtgcatgttcatgctgtgtttcgggagtggtgactgcccttctttacttataggagacttcaaagccagatggcccaatggttgcagttgctgagcctgtcagggtggtggtcctagacttcagtggtgtcacctttgcagatgctgctggggccagagaagtggtgcagctggccagccgatgtcgagatgctaggatccgcctcctcctggctcagtgtaatggtgagatgtgtggagaagagcggggcccagtgcctgggcaatgactggacacctgcggtagggaaaaggacccggtgtggacttagggtctcagagtctgacaccctccccacatagccttggtgcaggggacactgacccgggtaggactcctggacagggtgactccagatcagctgtttgtgagtgtgcaggatgcagctgcttatgccctggggagcctggtaaggggcagtagcaccaggagcgggagccaggaggcactgggctgcggcaagtgaggcaggggagctcactgacccaaagatttgcaccgtgtgggtctgacctcatcatgtggagtgcagagggccctgatgacatgtgtgtgatgaggaccatgacccttgaacccccttacctaacgtaactaataaaatgaagctgagagctttggaatccatgaagt

SEQ ID NO: 361732 - DNA, 2921 bp, Homo sapiens
ctctcatggtcagccccttctagcttctgccagggaccccatctcttcccatgccttcattttgctctctttttcaggtgcttctggcctccgtgctctgcttcacctcttctgtggacacaagataccaagtccagatagtggggctgttgcctggagggtaagagaatgaaaagatgccagctttctcttctcccacctctcccacccaacactccctcttatctccaccccccattttctctgccttccttatctcactgaagcacctaacccctcctcaccatggatccctccctctccagatttccccaacccctcctccccaacctggctgagctgcccaggattctggctgactcgctgcccattgcactggttagttttgcggtgtctgcctccctggcctccatccatgcagacaagtatagctacactattgactccaaccaggtgggactctgactgtggaccccaaccctctcatttgacttcccaccatgcctttgtctctcccacttcatctcactgtatccctccaggagttcctggcacatggtgcctccaacctcatctcctccctcttctcttgctttcccaactcggctacgctggccaccaccaatctactggtggatgctggtgggaaaacacaggtaagagggcatccttggatgaggagaaaggatgggccatccaggcaaggtggcggtggtggagaaacaggtggaagatggctagaatcccaggtggcacctatatagagaagactggggatctgtgagaaagggtgactgaggggatggaattatagataggagagatggaagataacaatgttccagtaagacctttgtaggctctaagcgctgaaaaagtttatggtgccccaggtgtggttcaaaataaaaacacaaaactataaaataaacttaagagataaaattcttatttttttcacacaatgacattgtcttttaaaaggaatatcacatatcaaagtctccccctaatatttttggtttcccttactttgctggtgccctaaacacatataccctgcttatagggtaacccaacagtggcttttaaggtggaggtgggctacaaaactggggaacttgaacaatggacatctacaaggagactggtgaataatgggcatttaattaattggggggagcgggagggttagatgtgaatggcagaatattaagaagggggttgtgtggaaggagatttgggagaagggagacttccgaggaagattaggcagagtgggcaggaagaccagctctcatgtgggggtgggaggctctcttccttttttgctcctgttcctccttttctctagctggcaggcctcttctcctgcacagtggtcctgtcggtgctgctgtggctggggcccttcttttactatctgcccaaggtaatgagcagaggaggcatgagcatggctgggaggggtagctgtattccaggacatcgaggtagtcagcccacctcctctgcctcaaggctgtcctggcttgcatcaacatctccagcatgcgccaggtgttctgccagatgcaggaacttccacaactatggcacatcagccgagtggactttgtgagaaatgccattacccccagattgccccctctcatcttgttagcatccccagcctctgccctgaaccaaacctaattgtcctggtcttaagttctgcaacccacccactcccccagcaaacataactcctagtatgctttactcacaggcaagggaaaggatggggtttgaacccctttggcctgaatatttgtaacttcccaactggtgcgggtcattacatttggtgtgtgtcccattgaatcaaccctgttgtttccttctgtcatgctttccacttcttcctggatcatctctccccatcacttgccttggtagtcactgccctggatctctttacccagcagtgatggcctggcttttcttttgggcaatccacccctatccctatcctgcaggctgtgtggatggtcacctgggtggcagtagtgaccctgagtgtggatttgggcctggctgtgggtgtggtcttctccatgatgactgtggtctgccgcacccggaggtgggcatagagatgagtggagttgaggtcggggcaggggaagagaatgaggtgcttggggtgactctccagccaggccaggctaagctggaaatctggccccaccttcttccctagggtgtagtgcctggcacttggacaggctgaggggacagagctctacagaccactcagaggaagccccagggtgggtgggctgcagccaaagaaggaagggaagattagccccagacatttctctgatcctttgacctcttagctcctccaggtcccggggctctgcatcctgagctatccaacaccactgtactttgggacccgtgggcagtttcgctgcaacctggagtggcacctggggctcggagaaggagaaaaggagacttcaaagccagatggcccaatggttgcagctggccagccgatgtcgagatgctaggatccgcctcctcctggctcagtgtaatgccttggtgcaggggacactgacccgggtaggactcctggacagggtgactccagatcagctgtttgtgagtgtgcaggatgcagctgcttatgccctggggagcctggtaaggggcagtagcaccaggagcgggagccaggaggcactgggctgcggcaagtgaggcaggggagctcactgacccaaagatttgcaccgtgtgggtctgacctcatcatgtggagtgcagagggccctgatgacatgtgtgtgatgaggaccatgacccttgaacccccttacctaacgtaactaataaaatgaagctgagagctttggaatccatgaagt

SEQ ID NO: 361733 - DNA, 2711 bp, Homo sapiens
ctctcatggtcagccccttctagcttctgccagggaccccatctcttcccatgccttcattttgctctctttttcaggtgcttctggcctccgtgctctgcttcacctcttctgtggacacaagataccaagtccagatagtggggctgttgcctggagggtaagagaatgaaaagatgccagctttctcttctcccacctctcccacccaacactccctcttatctccaccccccattttctctgccttccttatctcactgaagcacctaacccctcctcaccatggatccctccctctccagatttccccaacccctcctccccaacctggctgagctgcccaggattctggctgactcgctgcccattgcactggttagttttgcggtgtctgcctccctggcctccatccatgcagacaagtatagctacactattgactccaaccaggtgggactctgactgtggaccccaaccctctcatttgacttcccaccatgcctttgtctctcccacttcatctcactgtatccctccaggagttcctggcacatggtgcctccaacctcatctcctccctcttctcttgctttcccaactcggctacgctggccaccaccaatctactggtggatgctggtgggaaaacacaggtaagagggcatccttggatgaggagaaaggatgggccatccaggcaaggtggcggtggtggagaaacaggtggaagatggctagaatcccaggtggcacctatatagagaagactggggatctgtgagaaagggtgactgaggggatggaattatagataggagagatggaagataacaatgttccagtaagacctttgtaggctctaagcgctgaaaaagtttatggtgccccaggtgtggttcaaaataaaaacacaaaactataaaataaacttaagagataaaattcttatttttttcacacaatgacattgtcttttaaaaggaatatcacatatcaaagtctccccctaatatttttggtttcccttactttgctggtgccctaaacacatataccctgcttatagggtaacccaacagtggcttttaaggtggaggtgggctacaaaactggggaacttgaacaatggacatctacaaggagactggtgaataatgggcatttaattaattggggggagcgggagggttagatgtgaatggcagaatattaagaagggggttgtgtggaaggagatttgggagaagggagacttccgaggaagattaggcagagtgggcaggaagaccagctctcatgtgggggtgggaggctctcttccttttttgctcctgttcctccttttctctagctggcaggcctcttctcctgcacagtggtcctgtcggtgctgctgtggctggggcccttcttttactatctgcccaaggtaatgagcagaggaggcatgagcatggctgggaggggtagctgtattccaggacatcgaggtagtcagcccacctcctctgcctcaaggctgtcctggcttgcatcaacatctccagcatgcgccaggtgttctgccagatgcaggaacttccacaactatggcacatcagccgagtggactttgtgagaaatgccattacccccagattgccccctctcatcttgttagcatccccagcctctgccctgaaccaaacctaattgtcctggtcttaagttctgcaacccacccactcccccagcaaacataactcctagtatgctttactcacaggcaagggaaaggatggggtttgaacccctttggcctgaatatttgtaacttcccaactggtgcgggtcattacatttggtgtgtgtcccattgaatcaaccctgttgtttccttctgtcatgctttccacttcttcctggatcatctctccccatcacttgccttggtagtcactgccctggatctctttacccagcagtgatggcctggcttttcttttgggcaatccacccctatccctatcctgcaggctgtgtggatggtcacctgggtggcagtagtgaccctgagtgtggatttgggcctggctgtgggtgtggtcttctccatgatgactgtggtctgccgcacccggagctcctccaggtcccggggctctgcatcctgagctatccaacaccactgtactttgggacccgtgggcagtttcgctgcaacctggagtggcacctggggctcggagaaggagaaaagttgctgagcctgtcagggtggtggtcctagacttcagtggtgtcacctttgcagatgctgctggggccagagaagtggtgcagctggccagccgatgtcgagatgctaggatccgcctcctcctggctcagtgtaatgccttggtgcaggggacactgacccgggtaggactcctggacagggtgactccagatcagctgtttgtgagtgtgcaggatgcagctgcttatgccctggggagcctggtaaggggcagtagcaccaggagcgggagccaggaggcactgggctgcggcaagtgaggcaggggagctcactgacccaaagatttgcaccgtgtgggtctgacctcatcatgtggagtgcagagggccctgatgacatgtgtgtgatgaggaccatgacccttgaacccccttacctaacgtaactaataaaatgaagctgagagctttggaatccatgaagt

SEQ ID NO: 361734 - DNA, 853 bp, Homo sapiens
ccgcggccgtggccttcgggagcggggcgttgatggtgagggaggacccggggaggaacccggggggatccctgctgaggggccagggaaattgggccggggaagagggagggaccagctttcggcttgggttcgggagggcggaggtgcgcggggttggtttgctcctcctctagatggtgacagcgcgtcttctcccccacagctggggatgttcgtgctgcagctcggcgtcttgtccacctttttgtccgagcctgtggtcaaggcgctgaccagcggggccgcgctgcacgtgctcttgtcccagctgccgagcctcttggggttgtccctcccgcgccagatcggctgcttctctctcttcaaggtgggggtggaagaagaaaggagaaggggcttctagaggtcccgtgaatagggaaactcgaaaagggaggaaggacggagggtggaggggtagtatgtgacaagggagcaggaaaggaggttggagccacgtggctgaacgagggcgctgaggaggtgtaagccctggtggcactgggtagagagggcctcgctctgggggtcccgcgccggggcgcatgagccctggcacggggccctctgctcatcgcccctgccctcagacgctggcctccttgctgactgcgctgcctcggagcagtccggccgaactgaccatctccgcgctcagcctggcgctgctcgtgccggtcaaggaattgaacgtgagattccgagaccggctacccacgccgatcccgggggaagtcgtcttggtgaggatggccgtgcgcgccggccccctgcccgcgcagaccctgcggtcctgtgggaactggccgct

SEQ ID NO: 361735 - DNA, 1250 bp, Homo sapiens
ctctatggtttccgcggctcgctagaaggagtgcggtccactggaggtctccctacattcttcctccattatctcactgcctccggtggctgctgggataccggagactcgggtcccggctcgactcagtcctccagccgcccggggaatacctctagttcttcccggccgccgccgcctccgccccgccgcttcctcctccgcctgccggcctccttcgccccgccccgtccgcgcagcgcgtccggcccgcccgcaggccagcttctctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaaggctcatatgacattaacagacaagacacttttcagaaagacaggcaacgtgttggaccttccggagcttctcagaagacagagggttttcttttgaggctgttgtacagtggcctgattatagctcactgtagcctcgaaattctgggccgaaatgatccgcctgcctcagcctccaaagtagctgagactacaggtattgtttgggttttaatacagacaaatcaactcaatcaaagaaaccaactcaaagaaagatgggtctacatacaacaaaactgaacaaaatctgcaagaagagtgattcatacatgggctattgaggcaacatgagatggacattaatcgactaagtaaaaaacagatttcttgaagaattaataaagaacttttgttttggaaaaactctattgtttaaaattagccagatgtggtggcctgcacctacagtcccagctactcaggaggctgaggtggaaggatcacttgagcccaagaggcggaggttgcagtgagctgagactgtgccgctgcactacagacagcctcctgcatgacagagccagaccctgtctcaaaatttgggggggagtaaagttctctattgtttgaaataataacgaaacattaaaggctctaaagtcagctaacgaatagtcctaaaaatagaatggctcaaaaagattgtccaattttggaaaactaacatttcaaaaagttgtttcattttttatgaatcctaagatttccatatcctagaaaactaacatctcaga

SEQ ID NO: 361736 - DNA, 481 bp, Homo sapiens
cagttgctagtagtttgcttaatgtaagatatgggatgaatattttcatgatggcccctgcatctaagttatcatttagcagtacctgccttatctcttgtacagaatcagattagacagcataggaagaatgaaaaggtgaggtgggataataaggaatgttgtttgtggaaacataatggttgcttcaatttgagtgtaaactgtcctttttactgaagcaattgcaaccaagtgtgtgagttcacaggtgcctacattgcttttttggcttaggtattgtttgggttttaatacagacaaatcaactcaatcaaagaaaccaactcaaagaaagatgggtctacatacaacaaaactgaacaaaatctgcaagaagagtgattcatacatgggctattgaggcaacatgagatggacattaatcgactaagtaaaaaacagatttcttgaagaattaataaagaacttttgttttgga

SEQ ID NO: 361737 - DNA, 776 bp, Homo sapiens
tatagtccctttcttcccttacaggctcatatgacattaacagacaagacacttttcagaaagacaggcaacgtgttggaccttccggagcttctcagaagacagagggttttcttttgaggctgttgtacagtggcctgattatagctcactgtagcctcgaaattctgggccgaaatgatccgcctgcctcagcctccaaagtagctgagactacagacaaatcaactcaatcaaagaaaccaactcaaagaaagatgggtctacatacaacaaaactgaacaaaatctgcaagaagagtgattcatacatgggctattgaggcaacatgagatggacattaatcgactaagtaaaaaacagatttcttgaagaattaataaagaacttttgttttggaaaaactctattgtttaaaattagccagatgtggtggcctgcacctacagtcccagctactcaggaggctgaggtggaaggatcacttgagcccaagaggcggaggttgcagtgagctgagactgtgccgctgcactacagacagcctcctgcatgacagagccagaccctgtctcaaaatttgggggggagtaaagttctctattgtttgaaataataacgaaacattaaaggctctaaagtcagctaacgaatagtcctaaaaatagaatggctcaaaaagattgtccaattttggaaaactaacatttcaaaaagttgtttcattttttatgaatcctaagatttccatatcctagaaaactaacatctcaga

SEQ ID NO: 361738 - DNA, 856 bp, Homo sapiens
cagttgctagtagtttgcttaatgtaagatatgggatgaatattttcatgatggcccctgcatctaagttatcatttagcagtacctgccttatctcttgtacagaatcagattagacagcataggaagaatgaaaaggtgaggtgggataataaggaatgttgtttgtggaaacataatggttgcttcaatttgagtgtaaactgtcctttttactgaagcaattgcaaccaagtgtgtgagttcacaggtgcctacattgcttttttggcttaggtattgtttgggttttaatacagacaaatcaactcaatcaaagaaaccaactcaaagaaagatgggtctacatacaacaaaactgaacaaaatctgcaagaagagtgattcatacatgggctattgaggcaacatgagatggacattaatcgactaagtaaaaaacagatttcttgaagaattaataaagaacttttgttttggaaaaactctattgtttaaaattagccagatgtggtggcctgcacctacagtcccagctactcaggaggctgaggtggaaggatcacttgagcccaagaggcggaggttgcagtgagctgagactgtgccgctgcactacagacagcctcctgcatgacagagccagaccctgtctcaaaatttgggggggagtaaagttctctattgtttgaaataataacgaaacattaaaggctctaaagtcagctaacgaatagtcctaaaaatagaatggctcaaaaagattgtccaattttggaaaactaacatttcaaaaagttgtttcattttttatgaatcctaagatttccatatcctagaaaactaacatctcaga

SEQ ID NO: 361739 - DNA, 862 bp, Homo sapiens
ctctatggtttccgcggctcgctagaaggagtgcggtccactggaggtctccctacattcttcctccattatctcactgcctccggtggctgctgggataccggagactcgggtcccggctcgactcagtcctccagccgcccggggaatacctctagttcttcccggccgccgccgcctccgccccgccgcttcctcctccgcctgccggcctccttcgccccgccccgtccgcgcagcgcgtccggcccgcccgcaggccagcttctctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaagaaacttaaatcctcagtgtgacacaactcagtccttctactgcagcagctcttttataaaagcctcccaaagctccaagaaggaacaaagaatgtgacccagtaagctcacaccataagtctatattgcagaaacctttgttcaacaaaactgcagatgctctgttgaatccactggagattgtcctgatactaaggacaagtatgggaatttctacttatcttaaaaacatatatagatattgatctgcggagaaatatatctctgttatttcaaggctcatatgacattaacagacaagacacttttcagaaagacagaaactactctgaaaaactctcttaatgctttttacggccgggtgcggtggctggagcctgtaatcca

SEQ ID NO: 361740 - DNA, 840 bp, Homo sapiens
agtatgatcacctcttgccaatgcaatttcacttgatttgcaactggtgtttagtaaagaattttgctatgcaaaaatagtgtcttaattggattattgtaagacaaagtatgcatttttaatgtcgtattagtattttattaataaggctagggaaacccactaaatccctatactaaagtgaatttgattctcccatagaaacttaaatcctcagtgtgacacaactcagtccttctactgcagcagctcttttataaaagcctcccaaagctccaagaaggaacaaagaatgtgacccagtaagctcacaccataagtctatattgcagaaacctttgttcaacaaaactgcagatgctctgttgaatccactggagattgtcctgatactaaggacaagtatgctcatatgacattaacagacaagacacttttcagaaagacaggctgttgtacagtggcctgattatagctcactgtagcctcgaaattctgggccgaaatgatccgcctgcctcagcctccaaagtagctgagactacaggctggtcttgaactcttgggctgaagagattctcccacctcagcctcccaaggtgttgagattacaagcatgagccacctcacctggccaagagctagttgttaaaagagcctagcactacccccctctttcttgtttcctctctcaccatgtgatctccacacacattggcttgccttccctttctgacatgagcggaagcagcctgaggccctcaccagatgtggatgccagtgccatgcttcttgtacaatctgcagaatcataagctaaatacacctcttttctttata

SEQ ID NO: 361741 - DNA, 774 bp, Homo sapiens
ctgccccatcttcctcccttcttctaagactccagttacgtatgtattaggcctgttcaccacttcccacaagtatcttatgttctttgctgtattttccatactctttgtctctgtttttcagcttagagtttttattctgtcctgtattacagttcaaagaatgttccttctgctaaatctaattgtagttaacccatatgctaagtacttaatttcagttattgtatttttaagttttaaatttccatttcattctttcttatagattccagttctttgatgaaagtctctattccacccatcaagtctgtgtctgataacaccaatatctgggtcattagtggctccgttttgttgtgtctgttttcccctccttcctgttttgtggtgtgtttgatcacttattgttgaatgctaaccattataataaattttagtggctccaggaaacattatctgaaaacaatgtctgtctcaagggagggtttaccatgtcatctgatagacagagtgggaagattttaccttaatccaatggtactgaactgactagagtctatgttgcagtttttggaaggcttcatctccatctctggtttgcccatctatctagagtgtggtcctccaaggattccagctgagcgtctgatgtgattattaggcttcttttccttggtgggtcctgaactccaacttttatctcattaatatgacactgccaaaacctgctgcctttcatagcctttctgcatagcttaattcagcagatgc

SEQ ID NO: 361742 - DNA, 379 bp, Homo sapiens
cctcctggctttttgagaatcggctggcatcagggtgctgactgacaaacttcccggggtctgggcacggtggggacggagcctgcagacggcggtgtccccgctagaagagccgtggggacgtgattaacagttacaagctattgaggcactccagagtgacggcatgtgatccccctgacacaagaaacaggcccagataacacaccgttcagaccgacagcagttctggttatgctgcagtacatcagaaaagtgctcttatccatccacagttcttatcacagttacttatgcatatattcattttttatataaaagaatcttgaatcggtcacttaaatattgaatctcaataataaaaaatactaaaagttta

SEQ ID NO: 361743 - DNA, 1227 bp, Homo sapiens
ctctatggtttccgcggctcgctagaaggagtgcggtccactggaggtctccctacattcttcctccattatctcactgcctccggtggctgctgggataccggagactcgggtcccggctcgactcagtcctccagccgcccggggaatacctctagttcttcccggccgccgccgcctccgccccgccgcttcctcctccgcctgccggcctccttcgccccgccccgtccgcgcagcgcgtccggcccgcccgcaggccagcttctctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaaggctcatatgacattaacagacaagacacttttcagaaagacaggcaacgtgttggaccttccggagcttctcagaagacagagggttttcttttgaggctgttgtacagtggcctgattatagctcactgtagcctcgaaattctgggccgaaatgatccgcctgcctcagcctccaaagtagctgagactacagacaaatcaactcaatcaaagaaaccaactcaaagaaagatgggtctacatacaacaaaactgaacaaaatctgcaagaagagtgattcatacatgggctattgaggcaacatgagatggacattaatcgactaagtaaaaaacagatttcttgaagaattaataaagaacttttgttttggaaaaactctattgtttaaaattagccagatgtggtggcctgcacctacagtcccagctactcaggaggctgaggtggaaggatcacttgagcccaagaggcggaggttgcagtgagctgagactgtgccgctgcactacagacagcctcctgcatgacagagccagaccctgtctcaaaatttgggggggagtaaagttctctattgtttgaaataataacgaaacattaaaggctctaaagtcagctaacgaatagtcctaaaaatagaatggctcaaaaagattgtccaattttggaaaactaacatttcaaaaagttgtttcattttttatgaatcctaagatttccatatcctagaaaactaacatctcaga

SEQ ID NO: 361744 - DNA, 1331 bp, Homo sapiens
ctctatggtttccgcggctcgctagaaggagtgcggtccactggaggtctccctacattcttcctccattatctcactgcctccggtggctgctgggataccggagactcgggtcccggctcgactcagtcctccagccgcccggggaatacctctagttcttcccggccgccgccgcctccgccccgccgcttcctcctccgcctgccggcctccttcgccccgccccgtccgcgcagcgcgtccggcccgcccgcaggccagcttctctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaaggctcatatgacattaacagacaagacacttttcagaaagacagatggagtctctctgtcacccagactggaatgcagtggcatgatcttggttcactgaaacctctgcctttctggttcaagcaattctcatgtttcagcctcccaggcaacgtgttggaccttccggagcttctcagaagacagagggttttcttttgaggctgttgtacagtggcctgattatagctcactgtagcctcgaaattctgggccgaaatgatccgcctgcctcagcctccaaagtagctgagactacagacaaatcaactcaatcaaagaaaccaactcaaagaaagatgggtctacatacaacaaaactgaacaaaatctgcaagaagagtgattcatacatgggctattgaggcaacatgagatggacattaatcgactaagtaaaaaacagatttcttgaagaattaataaagaacttttgttttggaaaaactctattgtttaaaattagccagatgtggtggcctgcacctacagtcccagctactcaggaggctgaggtggaaggatcacttgagcccaagaggcggaggttgcagtgagctgagactgtgccgctgcactacagacagcctcctgcatgacagagccagaccctgtctcaaaatttgggggggagtaaagttctctattgtttgaaataataacgaaacattaaaggctctaaagtcagctaacgaatagtcctaaaaatagaatggctcaaaaagattgtccaattttggaaaactaacatttcaaaaagttgtttcattttttatgaatcctaagatttccatatcctagaaaactaacatctcaga

SEQ ID NO: 361745 - DNA, 1539 bp, Homo sapiens
ctctatggtttccgcggctcgctagaaggagtgcggtccactggaggtctccctacattcttcctccattatctcactgcctccggtggctgctgggataccggagactcgggtcccggctcgactcagtcctccagccgcccggggaatacctctagttcttcccggccgccgccgcctccgccccgccgcttcctcctccgcctgccggcctccttcgccccgccccgtccgcgcagcgcgtccggcccgcccgcaggccagcttctctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaagaaacttaaatcctcagtgtgacacaactcagtccttctactgcagcagctcttttataaaagcctcccaaagctccaagaaggaacaaagaatgtgacccagtaagctcacaccataagtctatattgcagaaacctttgttcaacaaaactgcagatgctctgttgaatccactggagattgtcctgatactaaggacaagtatgctcatatgacattaacagacaagacacttttcagaaagacaggttgttcttttgggccacatctaagaaatctttgtctagccaaaagccacaaataatttctcattttttggcttctggaagatgtacagttaaatgttatatttgggactgttatctaatttgattaaattgcactctacaatatgatatttgaattgatgaaaaattagtaaatgttaatattttttaaagtagccaaatcttgcaatttatatataatagagaagactagaaaatcccccatatttatttcctcttacttcgtactactaaaatttgtatttaggcatttggtttctcagataaacattacattccccagtatatggttctatctggcttggtgacgacatgttgaacattaagatgtgagcagaagtaatacatacacactctttttaatgtctttaattgaatgggatattggcccattttttcttccagtttattacactgaatattgacatgttattttccaatattgagacaatcaatgacaagactttaagagtaacaatgtaaaaattatagaagttgtctgagtttatcaacaatcccctggattagaaccccctaccagttctaggtcatctaatatatagacattgtgttcagtagaaataaatatatatattttttaatatactttaagttctaggatacatgtgcacaacatgcaggtttgttacattggtatacacatgccatgttggtttgctgcacccattaactcatcatttacattagttatttctcctaatgctatccctccccctgccccccaccccccgacaggccctggggtgtgatgttccc

SEQ ID NO: 361746 - DNA, 1341 bp, Homo sapiens
aattgctgatgataccaccaccaagaaatcatcaccattaatattttggcttttttgttttcagattttttccattatgaaattgttgatatttgatccttttgacctataaaaatgttaatatcatatagcttactcgaacatatccaaataatgtcatatatattattttatgtaccaaaaagcatactaaacagattgttttatagcttacttttctcatttttaacattataatttaagcatttgttcataatattaaaactttttgaaaacattattatgaatgactatttcaatatgtggatgtaccacaacttacctaatgatttacctactggtaatcattgagttggactggttggacatgagttgtttctaatttgtcgctattacaaataatgctctgataaatatgtataattaatttgtgtttcagattatttttatttctagaaatgagattcttggttataggctaaatatattttcttgttttttttttttttgttcatttgtttgtttgagatggagtctctctgtcacccagactggaatgcagtggcatgatcttggttcactgaaacctctgcctttctggttcaagcaattctcatgtttcagcctcccaggcaacgtgttggaccttccggagcttctcagaagacagagggttttcttttgaggctgttgtacagtggcctgattatagctcactgtagcctcgaaattctgggccgaaatgatccgcctgcctcagcctccaaagtagctgagactacagacaaatcaactcaatcaaagaaaccaactcaaagaaagatgggtctacatacaacaaaactgaacaaaatctgcaagaagagtgattcatacatgggctattgaggcaacatgagatggacattaatcgactaagtaaaaaacagatttcttgaagaattaataaagaacttttgttttggaaaaactctattgtttaaaattagccagatgtggtggcctgcacctacagtcccagctactcaggaggctgaggtggaaggatcacttgagcccaagaggcggaggttgcagtgagctgagactgtgccgctgcactacagacagcctcctgcatgacagagccagaccctgtctcaaaatttgggggggagtaaagttctctattgtttgaaataataacgaaacattaaaggctctaaagtcagctaacgaatagtcctaaaaatagaatggctcaaaaagattgtccaattttggaaaactaacatttcaaaaagttgtttcattttttatgaatcctaagatttccatatcctagaaaactaacatctcaga

SEQ ID NO: 361747 - DNA, 1369 bp, Homo sapiens
ctctatggtttccgcggctcgctagaaggagtgcggtccactggaggtctccctacattcttcctccattatctcactgcctccggtggctgctgggataccggagactcgggtcccggctcgactcagtcctccagccgcccggggaatacctctagttcttcccggccgccgccgcctccgccccgccgcttcctcctccgcctgccggcctccttcgccccgccccgtccgcgcagcgcgtccggcccgcccgcaggccagcttctctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaagaaacttaaatcctcagtgtgacacaactcagtccttctactgcagcagctcttttataaaagcctcccaaagctccaagaaggaacaaagaatgtgacccagtaagctcacaccataagtctatattgcagaaacctttgttcaacaaaactgcagatgctctgttgaatccactggagattgtcctgatactaaggacaagtatgctcatatgacattaacagacaagacacttttcagaaagacaggttgttcttttgggccacatctaagaaatctttgtctagccaaaagccacaaataatttctcattttttggcttctggaagatgtacagttaaatgttatatttgggactgttatctaatttgattaaattgcactctacaatatgatatttgaattgatgaaaaattagtaaatgttaatattttttaaagtagccaaatcttgcaatttatatataatagagaagactagaaaatcccccatatttatttcctcttacttcgtactactaaaatttgtatttaggcatttggtttctcagataaacattacattccccagtatatggttctatctggcttggtgacgacatgttgaacattaagatgtgagcagaagtaatacatacacactctttttaatgtctttaattgaatgggatattggcccattttttcttccagtttattacactgaatattgacatgttattttccaatattgagacaatcaatgacaagactttaagagtaacaatgtaaaaattatagaagttgtctgagtttatcaacaatcccctggattagaaccccctaccagttctaggtcatctaatatatagacattgtgttcagtagaaataaatatatatattttttaatatac

SEQ ID NO: 361748 - DNA, 963 bp, Homo sapiens
ctctatggtttccgcggctcgctagaaggagtgcggtccactggaggtctccctacattcttcctccattatctcactgcctccggtggctgctgggataccggagactcgggtcccggctcgactcagtcctccagccgcccggggaatacctctagttcttcccggccgccgccgcctccgccccgccgcttcctcctccgcctgccggcctccttcgccccgccccgtccgcgcagcgcgtccggcccgcccgcaggccagcttctctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaaggctcatatgacattaacagacaagacacttttcagaaagacaggcaacgtgttggaccttccggagcttctcagaagacagagggttttcttttgaggctgttgtacagtggcctgattatagctcactgtagcctcgaaattctgggccgaaatgatccgcctgcctcagcctccaaagtagctgagactacaggctggtcttgaactcttgggctgaagagattctcccacctcagcctcccaaggtgttgagattacaagcatgagccacctcacctggccaagagctagttgttaaaagagcctagcactacccccctctttcttgtttcctctctcaccatgtgatctccacacacattggcttgccttccctttctgacatgagcggaagcagcctgaggccctcaccagatgtggatgccagtgccatgcttcttgtacaatctgcagaatcataagctaaatacacctcttttctttata

SEQ ID NO: 361749 - DNA, 981 bp, Homo sapiens
ctctatggtttccgcggctcgctagaaggagtgcggtccactggaggtctccctacattcttcctccattatctcactgcctccggtggctgctgggataccggagactcgggtcccggctcgactcagtcctccagccgcccggggaatacctctagttcttcccggccgccgccgcctccgccccgccgcttcctcctccgcctgccggcctccttcgccccgccccgtccgcgcagcgcgtccggcccgcccgcaggccagcttctctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaaggctcatatgacattaacagacaagacacttttcagaaagacaggcaacgtgttggaccttccggagcttctcagaagacagagggttttcttttgaggctgttgtacagtggcctgattatagctcactgtagcctcgaaattctgggccgaaatgatccgcctgcctcagcctccaaagtagctgagactacaggtgtgtttgtcaaagtgtctctgatgaaccacaacaagtttgtcaagtgcaagaagacttcagctgtgctgggctccatcaaccctgtgtacaatgagaccttcagcttcaaggccgatgccaccaagctggataccgctagcctcagcctgaccgcggtgcagaacatggaaggggacagtaaggccacaccctaccctgggctgctgggatggggaccacgaggggctgccgagtgttcaggcagagtgagtgcctcctgtcctgacctcagaaggagctgtacgagctccctccctggttaaggaaac

SEQ ID NO: 361750 - DNA, 1280 bp, Homo sapiens
ctctatggtttccgcggctcgctagaaggagtgcggtccactggaggtctccctacattcttcctccattatctcactgcctccggtggctgctgggataccggagactcgggtcccggctcgactcagtcctccagccgcccggggaatacctctagttcttcccggccgccgccgcctccgccccgccgcttcctcctccgcctgccggcctccttcgccccgccccgtccgcgcagcgcgtccggcccgcccgcaggccagcttctctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaaggctcatatgacattaacagacaagacacttttcagaaagacagatggagtctctctgtcacccagactggaatgcagtggcatgatcttggttcactgaaacctctgcctttctggttcaagcaattctcatgtttcagcctcccaggcaacgtgttggaccttccggagcttctcagaagacagagggttttcttttgaggctgttgtacagtggcctgattatagctcactgtagcctcgaaattctgggccgaaatgatccgcctgcctcagcctccaaagtagctgagactacagattccagttctttgatgaaagtctctattccacccatcaagtctgtgtctgataacaccaatatctgggtcattagtggctccgttttgttgtgtctgttttcccctccttcctgttttgtggtgtgtttgatcacttattgttgaatgctaaccattataataaattttagtggctccaggaaacattatctgaaaacaatgtctgtctcaagggagggtttaccatgtcatctgatagacagagtgggaagattttaccttaatccaatggtactgaactgactagagtctatgttgcagtttttggaaggcttcatctccatctctggtttgcccatctatctagagtgtggtcctccaaggattccagctgagcgtctgatgtgattattaggcttcttttccttggtgggtcctgaactccaacttttatctcattaatatgacactgccaaaacctgctgcctttcatagcctttctgcatagcttaattcagcagatgc

SEQ ID NO: 361751 - DNA, 871 bp, Homo sapiens
ttttatgaagtcatatttattgttgttgtaactggtttttttgtttgttctctaggttgttcttttgggccacatctaagaaatctttgtctagccaaaagccacaaataatttctcattttttggcttctggaagatgtacagttaaatgttatatttgggactgttatctaatttgattaaattgcactctacaatatgatatttgaattgatgaaaaattagtaaatgttaatattttttaaagtagccaaatcttgcaatttatatataatagagaagactagaaaatcccccatatttatttcctcttacttcgtactactaaaatttgtatttaggcatttggtttctcagataaacattacattccccagtatatggttctatctggcttggtgacgacatgttgaacattaagatgtgagcagaagtaatacatacacactctttttaatgtctttaattgaatgggatattggcccattttttcttccagtttattacactgaatattgacatgttattttccaatattgagacaatcaatgacaagactttaagagtaacaatgtaaaaattatagaagttgtctgagtttatcaacaatcccctggattagaaccccctaccagttctaggtcatctaatatatagacattgtgttcagtagaaataaatatatatattttttaatatactttaagttctaggatacatgtgcacaacatgcaggtttgttacattggtatacacatgccatgttggtttgctgcacccattaactcatcatttacattagttatttctcctaatgctatccctccccctgccccccaccccccgacaggccctggggtgtgatgttccc

SEQ ID NO: 361752 - DNA, 762 bp, Homo sapiens
ccagggactgagagagggaacaggaaattggcaacgtgttggaccttccggagcttctcagaagacagagggttttcttttgaggctgttgtacagtggcctgattatagctcactgtagcctcgaaattctgggccgaaatgatccgcctgcctcagcctccaaagtagctgagactacaggtattgtttgggttttaatacagacaaatcaactcaatcaaagaaaccaactcaaagaaagatgggtctacatacaacaaaactgaacaaaatctgcaagaagagtgattcatacatgggctattgaggcaacatgagatggacattaatcgactaagtaaaaaacagatttcttgaagaattaataaagaacttttgttttggaaaaactctattgtttaaaattagccagatgtggtggcctgcacctacagtcccagctactcaggaggctgaggtggaaggatcacttgagcccaagaggcggaggttgcagtgagctgagactgtgccgctgcactacagacagcctcctgcatgacagagccagaccctgtctcaaaatttgggggggagtaaagttctctattgtttgaaataataacgaaacattaaaggctctaaagtcagctaacgaatagtcctaaaaatagaatggctcaaaaagattgtccaattttggaaaactaacatttcaaaaagttgtttcattttttatgaatcctaagatttccatatcctagaaaactaacatctcaga

SEQ ID NO: 361753 - DNA, 712 bp, Homo sapiens
ctctatggtttccgcggctcgctagaaggagtgcggtccactggaggtctccctacattcttcctccattatctcactgcctccggtggctgctgggataccggagactcgggtcccggctcgactcagtcctccagccgcccggggaatacctctagttcttcccggccgccgccgcctccgccccgccgcttcctcctccgcctgccggcctccttcgccccgccccgtccgcgcagcgcgtccggcccgcccgcaggccagcttctctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaaggctcatatgacattaacagacaagacacttttcagaaagacaggcaacgtgttggaccttccggagcttctcagaagacagagggttttcttttgaggtaaatttgatagtacattttgatagtacaggaggcgatacggcatggtgacagaaaagcgccggcttggttagcgggaccacctggcagggctgcaggctgtgccacttaccaggcaggggaccttgggccagctgctt

SEQ ID NO: 361754 - DNA, 527 bp, Homo sapiens
ttccgggttgtcaagtgtctctgatgaaccacaacaagttgtcaagtgcaagaagacttcagctgcaacgtgttggaccttccggagcttctcagaagacagagggttttcttttgaggctgttgtacagtggcctgattatagctcactgtagcctcgaaattctgggccgaaatgatccgcctgcctcagcctccaaagtagctgagactacaggtgtgtttgtcaaagtgtctctgatgaaccacaacaagtttgtcaagtgcaagaagacttcagctgtgctgggctccatcaaccctgtgtacaatgagaccttcagcttcaaggccgatgccaccaagctggataccgctagcctcagcctgaccgcggtgcagaacatggaaggggacagtaaggccacaccctaccctgggctgctgggatggggaccacgaggggctgccgagtgttcaggcagagtgagtgcctcctgtcctgacctcagaaggagctgtacgagctccctccctggttaaggaaac

SEQ ID NO: 361755 - DNA, 956 bp, Homo sapiens
ctctatggtttccgcggctcgctagaaggagtgcggtccactggaggtctccctacattcttcctccattatctcactgcctccggtggctgctgggataccggagactcgggtcccggctcgactcagtcctccagccgcccggggaatacctctagttcttcccggccgccgccgcctccgccccgccgcttcctcctccgcctgccggcctccttcgccccgccccgtccgcgcagcgcgtccggcccgcccgcaggccagcttctctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaaggctcatatgacattaacagacaagacacttttcagaaagacagatggagtctctctgtcacccagactggaatgcagtggcatgatcttggttcactgaaacctctgcctttctggttcaagcaattctcatgtttcagcctcccaggcaacgtgttggaccttccggagcttctcagaagacagagggttttcttttgaggctgttgtacagtggcctgattatagctcactgtagcctcgaaattctgggccgaaatgatccgcctgcctcagcctccaaagtagctgagactacagacaaatcaactcaatcaaagaaaccaactcaaagaaagatgggtctacatacaacaaaactgaacaaaatctgcaagaagagtgattcatacatgggctattgaggcaacatgagatggacattaatcgactaagtaaaaaacagatttcttgaagaattaataaagaacttttgttttgga

SEQ ID NO: 361756 - DNA, 959 bp, Homo sapiens
ctctatggtttccgcggctcgctagaaggagtgcggtccactggaggtctccctacattcttcctccattatctcactgcctccggtggctgctgggataccggagactcgggtcccggctcgactcagtcctccagccgcccggggaatacctctagttcttcccggccgccgccgcctccgccccgccgcttcctcctccgcctgccggcctccttcgccccgccccgtccgcgcagcgcgtccggcccgcccgcaggccagcttctctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaaggctcatatgacattaacagacaagacacttttcagaaagacaggcaacgtgttggaccttccggagcttctcagaagacagagggttttcttttgaggctgttgtacagtggcctgattatagctcactgtagcctcgaaattctgggccgaaatgatccgcctgcctcagcctccaaagtagctgagactacagactctggaagtctctctttggcgaacacctagcccccaactcccagggcacttcccagacagccaatgccacatcacaggcagcccctgctctgcccttggggtctgtgcctggcagaagggcggcagaccctcggcccctcttggcctgggccccagctcctccgggccctggaaccagcagaaacacccaccctgcgcctgatggactggacatgcttgttcccattggtgatggtgtgttgggagggaactgttttagaaaccaatgtaaatctgtgtctacatca

SEQ ID NO: 361757 - DNA, 1176 bp, Homo sapiens
ctctatggtttccgcggctcgctagaaggagtgcggtccactggaggtctccctacattcttcctccattatctcactgcctccggtggctgctgggataccggagactcgggtcccggctcgactcagtcctccagccgcccggggaatacctctagttcttcccggccgccgccgcctccgccccgccgcttcctcctccgcctgccggcctccttcgccccgccccgtccgcgcagcgcgtccggcccgcccgcaggccagcttctctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaaggctcatatgacattaacagacaagacacttttcagaaagacaggcaacgtgttggaccttccggagcttctcagaagacagagggttttcttttgaggctgttgtacagtggcctgattatagctcactgtagcctcgaaattctgggccgaaatgatccgcctgcctcagcctccaaagtagctgagactacagattccagttctttgatgaaagtctctattccacccatcaagtctgtgtctgataacaccaatatctgggtcattagtggctccgttttgttgtgtctgttttcccctccttcctgttttgtggtgtgtttgatcacttattgttgaatgctaaccattataataaattttagtggctccaggaaacattatctgaaaacaatgtctgtctcaagggagggtttaccatgtcatctgatagacagagtgggaagattttaccttaatccaatggtactgaactgactagagtctatgttgcagtttttggaaggcttcatctccatctctggtttgcccatctatctagagtgtggtcctccaaggattccagctgagcgtctgatgtgattattaggcttcttttccttggtgggtcctgaactccaacttttatctcattaatatgacactgccaaaacctgctgcctttcatagcctttctgcatagcttaattcagcagatgc

SEQ ID NO: 361758 - DNA, 888 bp, Homo sapiens
ctctatggtttccgcggctcgctagaaggagtgcggtccactggaggtctccctacattcttcctccattatctcactgcctccggtggctgctgggataccggagactcgggtcccggctcgactcagtcctccagccgcccggggaatacctctagttcttcccggccgccgccgcctccgccccgccgcttcctcctccgcctgccggcctccttcgccccgccccgtccgcgcagcgcgtccggcccgcccgcaggccagcttctctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaaggctcatatgacattaacagacaagacacttttcagaaagacaggcaacgtgttggaccttccggagcttctcagaagacagagggttttcttttgaggctgttgtacagtggcctgattatagctcactgtagcctcgaaattctgggccgaaatgatccgcctgcctcagcctccaaagtagctgagactacagattccagttctttgatgaaagtctctattccacccatcaagtctgtgtctgataacaccaatatctgggtcattagtggctccgttttgttgtgtctgttttcccctccttcctgttttgtggtgtgtttgatcacttattgttgaatgctaaccattataataaaaagagatgcggccaggtttccccctttttttcaccccgttcgataataccta

SEQ ID NO: 361759 - DNA, 3255 bp, Homo sapiens
gccgcccagcgactccccctccccctcccccagccccgccccgccccaacccggggctccgagccggagccgagtctgcgcctgggggaggaccatgcggcagtagcagccatgctgccctttctgctggccacactgggcaccacagccctcaacaacagcaaccccaaggactactgctacagcgcccgcatccgcagcactgtcctgcagggcctgccctttgggggcgtccccaccgtgctggctctcgacttcatgtgcttccttgcactgctgttcttattctctatcctccggaaggtggcctgggactatgggcggctggccttggtgacagatgcagacaggcttcggcggcaggagagggaccgagtggaacaggaatatgtggcttcagctatgcacggggacagccatgaccggtatgagcgtctcacctctgtctccagctccgttgactttgaccaaagggacaatggtttctgttcctggctgacagccatcttcaggataaaggatgatgagatccgggacaaatgtgggggcgatgccgtgcactacctgtcctttcagcggcacatcatcgggctgctggtggttgtgggcgtcctctccgtaggcatcgtgctgcctgtcaacttctcaggggacctgctggagaacaatgcctacagctttgggagaaccaccattgccaacttgaaatcagggaacaacctgctatggctgcacacctccttcgccttcctgtatctgctgctcaccgtctacagcatgcgtagacacacctccaagatgcgctacaaggaggatgatctggtgaagcggaccctcttcatcaatggaatctccaaatatgcagagtcagaaaagatcaagaagcattttgaggaagcctaccccaactgcacagttctcgaagcccgcccgtgttacaacgtggctcgcctaatgttcctcgatgcagagaggaagaaggccgagcggggaaagctgtacttcacaaacctccagagcaaggagaacgtgcctaccatgatcaaccccaagccctgtggccacctctgctgctgtgtggtgcgaggctgtgagcaggtggaggccattgagtactacacaaagctggagcagaagctgaaggaagactacaagcgggagaaggagaaggtgaatgagaagcctcttggcatggcctttgtcaccttccacaatgagactatcaccgccatcatcctgaaggacttcaacgtgtgtaaatgccagggctgcacctgccgtggggagccacgcccctcatcctgcagcgagtccctgcacatctccaactggaccgtgtcctatgcccctgaccctcagaacatctactgggagcacctctccatccgaggcttcatctggtggctgcgctgcctggtcatcaatgtcgtcctcttcatcctcctcttcttcctcaccactccagccatcatcatcaccaccatggacaagttcaacgtcaccaagcctgtggagtacctcaacaaccccatcatcacccagttcttccccaccctgctgctgtggtgcttctcggccctccttcccaccatcgtctactactcagccttctttgaagcccactggacacgctctggggagaacaggacaaccatgcacaagtgctacactttcctcatcttcatggtgctgctcctaccctcgctgggactgagcagcctggacctcttcttccgctggctctttgataagaaattcttggctgaggcagctattcggtttgagtgtgtgttcctgcccgacaacggcgccttcttcgtgaactacgtcattgcctcagcctttatcggcaacgccatggacctgctgcgcatcccaggcctgctcatgtacatgatccggctctgcctggcgcgctcggccgccgagaggcgcaacgtgaagcggcatcaggcctacgagttccagtttggcgcagcctacgcctggatgatgtgcgtcttcacggtggtcatgacctacagtatcacctgccccatcatcgtgcccttcgggctcatgtacatgctgctgaagcacctggtagacaggtacaatctctactacgcctacctgccggccaagctggacaagaagatccactcgggggctgtgaaccaggtggtggccgcgcccatcctctgcctcttctggctgctcttcttttccaccatgcgcacggggttcctagctcccacgtctatgttcacatttgtggtcctggtcatcaccatcgtcatctgtctctgccacgtctgctttggacacttcaaatacctcagtgcccacaactacaagattgagcacacggagacagatactgtggaccccagaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttccagtcttgcgaggacagcctcatagagaatgagattcaccagtaaggggagggaggggccctggaggccacatcctgccccaccccacccccactcccacggacactaaaacgctaataatttattagatctaaagccccttcctccccagcccctgctttcattaaggtatttaaacttgggggtttcactgctctcccccatgatggagggagggagccccccaacctcagtgaggagagccccgagccggccccggggcaaagaggggtgcagagggagttcccccagatcagtaccccccacccctccccagctagtagcatgaccaggagagggttaatgagagccaagaggagtacctggtgcacctggtgccggtggctggagacctggggggcaggtggatctggggctgttcccccccctccgttttttccaccccacagttcctcctgggatctggccctccagggaagtggagcctccagcccctaggggatgcatgaggggggagggggtgctgagtgggaggaagagtcaggctcacagctggggtggcctgggggtgggggtgggcaaggctgacactggaaaatgggtttttgcactgttttttttttggtttttttgttcttttttgtttttttcctttaaaataaaaacaaagaaaagctctgaaaaaaaaaa

SEQ ID NO: 361760 - DNA, 2951 bp, Homo sapiens
gccgcccagcgactccccctccccctcccccagccccgccccgccccaacccggggctccgagccggagccgagtctgcgcctgggggaggaccatgcggcagtagcagccatgctgccctttctgctggccacactgggcaccacagccctcaacaacagcaaccccaaggactactgctacagcgcccgcatccgcagcactgtcctgcagggcctgccctttgggggcgtccccaccgtgctggctctcgacttcatgtgcttccttgcactgctgttcttattctctatcctccggaaggtggcctgggactatgggcggctggccttggtgacagatgcagacaggcttcggcggcaggagagggaccgagtggaacaggaatatgtggcttcagctatgcacggggacagccatgaccggtatgagcgtctcacctctgtctccagctccgttgactttgaccaaagggacaatggtttctgttcctggctgacagccatcttcaggataaagtgaagcggaccctcttcatcaatggaatctccaaatatgcagagtcagaaaagatcaagaagcattttgaggaagcctaccccaactgcacagttctcgaagcccgcccgtgttacaacgtggctcgcctaatgttcctcgatgcagagaggaagaaggccgagcggggaaagctgtacttcacaaacctccagagcaaggagaacgtgcctaccatgatcaaccccaagccctgtggccacctctgctgctgtgtggtgcgaggctgtgagcaggtggaggccattgagtactacacaaagctggagcagaagctgaaggaagactacaagcgggagaaggagaaggtgaatgagaagcctcttggcatggcctttgtcaccttccacaatgagactatcaccgccatcatcctgaaggacttcaacgtgtgtaaatgccagggctgcacctgccgtggggagccacgcccctcatcctgcagcgagtccctgcacatctccaactggaccgtgtcctatgcccctgaccctcagaacatctactgggagcacctctccatccgaggcttcatctggtggctgcgctgcctggtcatcaatgtcgtcctcttcatcctcctcttcttcctcaccactccagccatcatcatcaccaccatggacaagttcaacgtcaccaagcctgtggagtacctcaacaaccccatcatcacccagttcttccccaccctgctgctgtggtgcttctcggccctccttcccaccatcgtctactactcagccttctttgaagcccactggacacgctctggggagaacaggacaaccatgcacaagtgctacactttcctcatcttcatggtgctgctcctaccctcgctgggactgagcagcctggacctcttcttccgctggctctttgataagaaattcttggctgaggcagctattcggtttgagtgtgtgttcctgcccgacaacggcgccttcttcgtgaactacgtcattgcctcagcctttatcggcaacgccatggacctgctgcgcatcccaggcctgctcatgtacatgatccggctctgcctggcgcgctcggccgccgagaggcgcaacgtgaagcggcatcaggcctacgagttccagtttggcgcagcctacgcctggatgatgtgcgtcttcacggtggtcatgacctacagtatcacctgccccatcatcgtgcccttcgggctcatgtacatgctgctgaagcacctggtagacaggtacaatctctactacgcctacctgccggccaagctggacaagaagatccactcgggggctgtgaaccaggtggtggccgcgcccatcctctgcctcttctggctgctcttcttttccaccatgcgcacggggttcctagctcccacgtctatgttcacatttgtggtcctggtcatcaccatcgtcatctgtctctgccacgtctgctttggacacttcaaatacctcagtgcccacaactacaagattgagcacacggagacagatactgtggaccccagaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttccagtcttgcgaggacagcctcatagagaatgagattcaccagtaaggggagggaggggccctggaggccacatcctgccccaccccacccccactcccacggacactaaaacgctaataatttattagatctaaagccccttcctccccagcccctgctttcattaaggtatttaaacttgggggtttcactgctctcccccatgatggagggagggagccccccaacctcagtgaggagagccccgagccggccccggggcaaagaggggtgcagagggagttcccccagatcagtaccccccacccctccccagctagtagcatgaccaggagagggttaatgagagccaagaggagtacctggtgcacctggtgccggtggctggagacctggggggcaggtggatctggggctgttcccccccctccgttttttccaccccacagttcctcctgggatctggccctccagggaagtggagcctccagcccctaggggatgcatgaggggggagggggtgctgagtgggaggaagagtcaggctcacagctggggtggcctgggggtgggggtgggcaaggctgacactggaaaatgggtttttgcactgttttttttttggtttttttgttcttttttgtttttttcctttaaaataaaaacaaagaaaagctctgaaaaaaaaaa

SEQ ID NO: 361761 - DNA, 3126 bp, Homo sapiens
gccgcccagcgactccccctccccctcccccagccccgccccgccccaacccggggctccgagccggagccgagtctgcgcctgggggaggaccatgcggcagtagcagccatgctgccctttctgctggccacactgggcaccacagccctcaacaacagcaaccccaaggactactgctacagcgcccgcatccgcagcactgtcctgcagggcctgccctttgggggcgtccccaccgtgctggctctcgacttcatgtgcttccttgcactgctgttcttattctctatcctccggaaggtggcctgggactatgggcggctggccttggtgacagatgcagacaggcttcggcggcaggagagggaccgagtggaacaggaatatgtggcttcagctatgcacggggacagccatgaccggtatgagcgtctcacctctgtctccagctccgttgactttgaccaaagggacaatggtttctgttcctggctgacagccatcttcaggataaaggatgatgagatccgggacaaatgtgggggcgatgccgtgcactacctgtcctttcagcggcacatcatcgggctgctggtggttgtgggcgtcctctccgtaggcatcgtgctgcctgtcaacttctcaggggacctgctggagaacaatgcctacagctttgggagaaccaccattgccaacttgaaatcagggaacaacctgctatggctgcacacctccttcgccttcctgtatctgctgctcaccgtctacagcatgcgtagacacacctccaagatgcgctacaaggaggatgatctggtgaagcggaccctcttcatcaatggaatctccaaatatgcagagtcagaaaagatcaagaagcattttgaggaagcctaccccaactgcacagttctcgaagcccgcccgtgttacaacgtggctcgcctaatgttcctcgatgcagagaggaagaaggccgagcggggaaagctgtacttcacaaacctccagagcaaggagaacgtgcctaccatgatcaaccccaagccctgtggccacctctgctgctgtgtggtgcgaggctgtgagcaggtggaggccattgagtactacacaaagctggagcagaagctgaaggaagactacaagcgggagaaggagaaggtgaatgagaagcctcttggcatggcctttgtcaccttccacaatgagactatcaccgccatcatcctgaaggacttcaacgtgtgtaaatgccagggctgcacctgccgtggggagccacgcccctcatcctgcagcgagtccctgcacatctccaactggaccgtgtcctatgcccctgaccctcagaacatctactgggagcacctctccatccgaggcttcatctggtggctgcgctgcctggtcatcaatgtcgtcctcttcatcctcctcttcttcctcaccactccagccatcatcatcaccaccatggacaagttcaacgtcaccaagcctgtggagtacctcaacaaccccatcatcacccagttcttccccaccctgctgctgtggtgcttctcggccctccttcccaccatcgtctactactcagccttctttgaagcccactggacacgctctggggagaacaggacaaccatgcacaagtgctacactttcctcatcttcatggtgctgctcctaccctcgctgggactgagcagcctggacctcttcttccgctggctctttgataagaaattcttggctgaggcagctattcggtttgagtgtgtgttcctgcccgacaacggcgccttcttcgtgaactacgtcattgcctcagcctttatcggcaacgccatggacctgctgcgcatcccaggcctgctcatgtacatgatccggctctgcctggcgcgctcggccgccgagaggcgcaacgtgaagcggcatcaggcctacgagttccagtttggcgcagcctacgcctggatgatgtgcgtcttcacggtggtcatgacctacagtatcacctgccccatcatcgtgcccttcgggctcatgtacatgctgctgaagcacctggtagacaggtacaatctctactacgcctacctgccggccaagctggacaagaagatccactcgggggctgtgaaccaggtggtggccgcgcccatcctctgcctcttctggctgctcttcttttccaccatgcgcacggggttcctagctcccacgtctatgttcacatttgtggtcctggtcatcaccatcgtcatctgtctctgccacgtctgctttggacacttcaaatacctcagtgcccacaactacaagattgagcacacggagacagatactgtggaccccagaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttccagtcttgcgaggacagcctcatagagaatgagattcaccagtaaggggagggaggggccctggaggccacatcctgccccaccccacccccactcccacggacactaaaacgctaataatttattagatctaaagccccttcctccccagcccctgctttcattaaggtatttaaacttgggggtttcactgctctcccccatgatggagggagggagccccccaacctcagtgaggagagccccgagccggccccggggcaaagaggggtgcagagggagttcccccagatcagtaccccccacccctccccagctagtagcatgaccaggagagggttaatgagagccaagaggagtacctggtgcacctggtgccggtggctggagacctggggggcaggtggatctggggctgttcccccccctccgttttttccaccccacagttcctcctgggatctggccctccagggaagtggagcctccagcccctaggggatgcatgaggggggaggggtttcatcttgtaattttccaattatatatatttatttatat

SEQ ID NO: 361762 - DNA, 3143 bp, Homo sapiens
gccgcccagcgactccccctccccctcccccagccccgccccgccccaacccggggctccgagccggagccgagtctgcgcctgggggaggaccatgcggcagtagcagccatgctgccctttctgctggccacactgggcaccacagccctcaacaacagcaaccccaaggactactgctacagcgcccgcatccgcagcactgtcctgcagggcctgccctttgggggcgtccccaccgtgctggctctcgacttcatgtgcttccttgcactgctgttcttattctctatcctccggaaggtggcctgggactatgggcggctggccttggtgacagatgcagacaggcttcggcggcaggagagggaccgagtggaacaggaatatgtggcttcagctatgcacggggacagccatgaccggtatgagcgtctcacctctgtctccagctccgttgactttgaccaaagggacaatggtttctgttcctggctgacagccatcttcaggataaaggatgatgagatccgggacaaatgtgggggcgatgccgtgcactacctgtcctttcagcggcacatcatcgggctgctggtggttgtgggcgtcctctccgtaggcatcgtgctgcctgtcaacttctcaggggacctgctggagaacaatgcctacagctttgggagaaccaccattgccaacttgaaatcagggaacaacctgctatggctgcacacctccttcgccttcctgtatctgctgctcaccgtctacagcatgcgtagacacacctccaagatgcgctacaaggaggatgatctggtgaagcggaccctcttcatcaatggaatctccaaatatgcagagtcagaaaagatcaagaagcattttgaggaagcctaccccaactgcacagttctcgaagcccgcccgtgttacaacgtggctcgcctaatgttcctcgatgcagagaggaagaaggccgagcggggaaagctgtacttcacaaacctccagagcaaggagaacgtgcctaccatgatcaaccccaagccctgtggccacctctgctgctgtgtggtgcgaggctgtgagcaggtggaggccattgagtactacacaaagctggagcagaagctgaaggaagactacaagcgggagaaggagaaggtgaatgagaagcctcttggcatggcctttgtcaccttccacaatgagactatcaccgccatcatcctgaaggacttcaacgtgtgtaaatgccagggctgcacctgccgtggggagccacgcccctcatcctgcagcgagtccctgcacatctccaactggaccgtgtcctatgcccctgaccctcagaacatctactgggagcacctctccatccgaggcttcatctggtggctgcgctgcctggtcatcaatgtcgtcctcttcatcctcctcttcttcctcaccactccagccatcatcatcaccaccatggacaagttcaacgtcaccaagcctgtggagtacctcaacaaccccatcatcacccagttcttccccaccctgctgctgtggtgcttctcggccctccttcccaccatcgtctactactcagccttctttgaagcccactggacacgctctggggagaacaggacaaccatgcacaagtgctacactttcctcatcttcatggtgctgctcctaccctcgctgggactgagcagcctggacctcttcttccgctggctctttgataagaaattcttggctgaggcagctattcggtttgagtgtgtgttcctgcccgacaacggcgccttcttcgtgaactacgtcattgcctcagcctttatcggcaacgccatggacctgctgcgcatcccaggcctgctcatgtacatgatccggctctgcctggcgcgctcggccgccgagaggcgcaacgtgaagcggcatcaggcctacgagttccagtttggcgcagcctacgcctggatgatgtgcgtcttcacggtggtcatgacctacagtatcacctgccccatcatcgtgcccttcgggctcatgtacatgctgctgaagcacctggtagacaggtacaatctctactacgcctacctgccggccaagctggacaagaagatccactcgggggctgtgaaccaggtggtggccgcgcccatcctctgcctcttctggctgctcttcttttccaccatgcgcacggggttcctagctcccacgtctatgttcacatttgtggtcctggtcatcaccatcgtcatctgtctctgccacgtctgctttggacacttcaaatacctcagtgcccacaactacaagattgagcacacggagacagatactgtggaccccagaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttccagtcttgcgaggacagcctcatagagaatgagattcaccagtaaggggagggaggggccctggaggccacatcctgccccaccccacccccactcccacggacactaaaacgctaataatttattagatctaaagccccttcctccccagcccctgctttcattaaggtatttaaacttgggggtttcactgctctcccccatgatggagggagggagccccccaacctcagtgaggagagccccgagccggccccggggcaaagaggggtgcagagggagttcccccaggtggatctggggctgttcccccccctccgttttttccaccccacagttcctcctgggatctggccctccagggaagtggagcctccagcccctaggggatgcatgaggggggagggggtgctgagtgggaggaagagtcaggctcacagctggggtggcctgggggtgggggtgggcaaggctgacactggaaaatgggtttttgcactgttttttttttggtttttttgttcttttttgtttttttcctttaaaataaaaacaaagaaaagctctgaaaaaaaaaa

SEQ ID NO: 361763 - DNA, 2693 bp, Homo sapiens
gccgcccagcgactccccctccccctcccccagccccgccccgccccaacccggggctccgagccggagccgagtctgcgcctgggggaggaccatgcggcagtagcagccatgctgccctttctgctggccacactgggcaccacagccctcaacaacagcaaccccaaggactactgctacagcgcccgcatccgcagcactgtcctgcagggcctgccctttgggggcgtccccaccgtgctggctctcgacttcatgtgcttccttgcactgctgttcttattctctatcctccggaaggtggcctgggactatgggcggctggccttggtgacagatgcagacaggcttcggcggcaggagagggaccgagtggaacaggaatatgtggcttcagctatgcacggggacagccatgaccggtatgagcgtctcacctctgtctccagctccgttgactttgaccaaagggacaatggtttctgttcctggctgacagccatcttcaggataaaggatgatgagatccgggacaaatgtgggggcgatgccgtgcactacctgtcctttcagcggcacatcatcgggctgctggtggttgtgggcgtcctctccgtaggcatcgtgctgcctgtcaacttctcaggggacctgctggagaacaatgcctacagctttgggagaaccaccattgccaacttgaaatcagggaacaacctgctatggctgcacacctccttcgccttcctgtatctgctgctcaccgtctacagcatgcgtagacacacctccaagatgcgctacaaggaggatgatctggtgaagcggaccctcttcatcaatggaatctccaaatatgcagagtcagaaaagatcaagaagcattttgaggaagcctaccccaactgcacagttctcgaagcccgcccgtgttacaacgtggctcgcctaatgttcctcgatgcagagaggaagaaggccgagcggggaaagctgtacttcacaaacctccagagcaaggagaacgtgcctaccatgatcaaccccaagccctgtggccacctctgctgctgtgtggtgcgaggctgtgagcaggtggaggccattgagtactacacaaagctggagcagaagctgaaggaagactacaagcgggagaaggagaaggtgaatgagaagcctcttggcatggcctttgtcaccttccacaatgagactatcaccgccatcatcctgaaggacttcaacgtgtgtaaatgccagggctgcacctgccgtggggagccacgcccctcatcctgcagcgagtccctgcacatctccaactggaccgtgtcctatgcccctgaccctcagaacatctactgggagcacctctccatccgaggcttcatctggtggctgcgctgcctggtcatcaatgtcgtcctcttcatcctcctcttcttcctcaccactccagccatcatcatcaccaccatggacaagttcaacgtcaccaagcctgtggagtacctcaacaaccccatcatcacccagttcttccccaccctgctgctgtggtgcttctcggccctccttcccaccatcgtctactactcagccttctttgaagcccactggacacgctctggggagaacaggacaaccatgcacaagtgctacactttcctcatcttcatggtgctgctcctaccctcgctgggactgagcagcctggacctcttcttccgctggctctttgataagaaattcttggctgaggcagctattcggtttgagtgtgtgttcctgcccgacaacggcgccttcttcgtgaactacgtcattgcctcagcctttatcggcaacgccatggacctgctgcgcatcccaggcctgctcatgtacatgatccggctctgcctggcgcgctcggccgccgagaggcgcaacgtgaagcggcatcaggcctacgagttccagtttggcgcagcctacgcctggatgatgtgcgtcttcacggtggtcatgacctacagtatcacctgccccatcatcgtgcccttcgggctcatgtacatgctgctgaagcacctggtagacaggtacaatctctactacgcctacctgccggccaagctggacaagaagatccactcgggggctgtgaaccaggtggtggccgcgcccatcctctgcctcttctggctgctcttcttttccaccatgcgcacggggttcctagctcccacgtctatgttcacatttgtggtcctggtcatcaccatcgtcatctgtctctgccacgtctgctttggacacttcaaatacctcagtgcccacaactacaagattgagcacacggagacagatactgtggaccccagaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccgctcacagctggggtggcctgggggtgggggtgggcaaggctgacactggaaaatgggtttttgcactgttttttttttggtttttttgttcttttttgtttttttcctttaaaataaaaacaaagaaaagctctgaaaaaaaaaa

SEQ ID NO: 361764 - DNA, 1810 bp, Homo sapiens
gccgcccagcgactccccctccccctcccccagccccgccccgccccaacccggggctccgagccggagccgagtctgcgcctgggggaggaccatgcggcagtagcagccatgctgccctttctgctggccacactgggcaccacagccctcaacaacagcaaccccaaggactactgctacagcgcccgcatccgcagcactgtcctgcagggcctgccctttgggggcgtccccaccgtgctggctctcgacttcatgtgcttccttgcactgctgttcttattctctatcctccggaaggtggcctgggactatgggcggctggccttggtgacagatgcagacaggcttcggcggcaggagagggaccgagtggaacaggaatatgtggcttcagctatgcacggggacagccatgaccggtatgagcgtctcacctctgtctccagctccgttgactttgaccaaagggacaatggtttctgttcctggctgacagccatcttcaggataaaggatgatgagatccgggacaaatgtgggggcgatgccgtgcactacctgtcctttcagcggcacatcatcgggctgctggtggttgtgggcgtcctctccgtaggcatcgtgctgcctgtcaacttctcaggggacctgctggagaacaatgcctacagctttgggagaaccaccattgccaacttgaaatcagggaacaacctgctatggctgcacacctccttcgccttcctgtatctgctgctcaccgtctacagcatgcgtagacacacctccaagatgcgctacaaggaggatgatctggtgaagcggaccctcttcatcaatggaatctccaaatatgcagagtcagaaaagatcaagaagcattttgaggaagcctaccccaactgcacagttctcgaagcccgcccgtgttacaacgtggctcgcctaatgttcctcgatgcagagaggaagaaggccgagcggggaaagctgtacttcacaaacctccagagcaaggagaacgtgcctaccatgatcaaccccaagccctgtggccacctctgctgctgtgtggtgcgaggctgtgagcaggtggaggccattgagtactacacaaagctggagcagaagctgaaggaagactacaagcgggagaaggagaaggtgaatgagaagcctcttggcatggcctttgtcaccttccacaatgagactatcaccgccatcatcctgaaggacttcaacgtgtgtaaatgccagggctgcacctgccgtggggagccacgcccctcatcctgcagcgagtccctgcacatctccaactggaccgtgtcctatgcccctgaccctcagaacatctactgggagcacctctccatccgaggcttcatctggtggctgcgctgcctggtcatcaatgtcgtcctcttcatcctcctcttcttcctcaccactccagccatcatcatcaccaccatggacaagttcaacgtcaccaagcctgtggagtacctcaacaaccccatcatcacccagttcttccccaccctgctgctgtggtgcttctcggccctccttcccaccatcgtctactactcagccttctttgaagcccactggacacgctctggggagaacaggacaaccatgcacaagtgctacactttcctcatcttcatggtgctgctcctaccctcgctgggactgagcagcctggacctcttcttccgctggctctttgataagaaattcttggctgaggcagctattcggtttgagtgagtgactggggcccctagggaaa

SEQ ID NO: 361765 - DNA, 1391 bp, Homo sapiens
ggggttgtagcggaggaagctgaagttctgtgatcacgctggggcacggggcactatcccgtcctggggcccgggcaggaggagggggccaacccttcagcactctcaggaccagaacaacctgtgacagacacacaaaaggttcggcagcactggttccgaggtcagggcccatgtggcttcccttagggctcatgtacatgctgctgaagcacctggtagacaggtacaatctctactacgcctacctgccggccaagctggacaagaagatccactcgggggctgtgaaccaggtggtggccgcgcccatcctctgcctcttctggctgctcttcttttccaccatgcgcacggggttcctagctcccacgtctatgttcacatttgtggtcctggtcatcaccatcgtcatctgtctctgccacgtctgctttggacacttcaaatacctcagtgcccacaactacaagattgagcacacggagacagatactgtggaccccagaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttccagtcttgcgaggacagcctcatagagaatgagattcaccagtaaggggagggaggggccctggaggccacatcctgccccaccccacccccactcccacggacactaaaacgctaataatttattagatctaaagccccttcctccccagcccctgctttcattaaggtatttaaacttgggggtttcactgctctcccccatgatggagggagggagccccccaacctcagtgaggagagccccgagccggccccggggcaaagaggggtgcagagggagttcccccagatcagtaccccccacccctccccagctagtagcatgaccaggagagggttaatgagagccaagaggagtacctggtgcacctggtgccggtggctggagacctggggggcaggtggatctggggctgttcccccccctccgttttttccaccccacagttcctcctgggatctggccctccagggaagtggagcctccagcccctaggggatgcatgaggggggagggggtgctgagtgggaggaagagtcaggctcacagctggggtggcctgggggtgggggtgggcaaggctgacactggaaaatgggtttttgcactgttttttttttggtttttttgttcttttttgtttttttcctttaaaataaaaacaaagaaaagctctgaaaaaaaaaa

SEQ ID NO: 361766 - DNA, 433 bp, Homo sapiens
ccatccacccaggcagcctggtgatctgtcctcactgccccctccccacgcccaccctactgggccatgaaggggatgggggcaagcccagctgactgctccaccctctgcccaggaggaccatgcggcagtagcagccatgctgccctttctgctggccacactgggcaccacagccctcaacaacagcaaccccaaggactactgctacagcgcccgcatccgcagcactgtcctgcagggcctgccctttgggggcgtccccaccgtgctggctctcgacttcatgtgcttccttgtaagtgcctgctgccaccccttaccttggcatccatgccctgtacacacctggcaaacacttccagctctaaccactctcccacctgccccggtttcccaggcttaagcaggaggagtccccatcatccagccc

SEQ ID NO: 361767 - DNA, 605 bp, Homo sapiens
agaacaatgcctacagctttgggagaaccaccattgccaacttgaaatcagggtaagatgcgaagctggtcggccaggccaaggtctacgaccagagtctgggccatgatgtgggacagggaggaaaggcagctgcgttgatgggagcagagcctacagggatggctatgggtccctgagggcttgggttggagacagaagagggaaatgcctgctgaggatcccccaaggatgaagaggatacagaagaggagggtgaaatctcaggaaccagggagggccagctggggcagttggagacactgtaaccagtgggtagggcgtagaaaggtgacctatcagggatattttcattggaatcgaagaattttggtgtctaggggatgtgggatgtgggcctgccttgcgaggagtcagtgccagaaggctggtggcagtagagggccctgtctgtatcaagggtttaacactgacaggctgaggtgtctcctctgagtgtgtcctagccccagtggctcccatgtatcctctctgcttctcccaggaacaacctgctatggctgcacacctccttcgccttcctgtatctgctgctcaccgtctac

SEQ ID NO: 361768 - DNA, 3262 bp, Homo sapiens
acccaaagaaaaaacctggactcagctgcgcgtcccctcccttcaacctcctgcgggacccagaggtgcccgggcccgcgggacccaggggtggcgcgcgctgcccccaaccccgcaccatcccgagccaaatgaggaccatgcggcagtagcagccatgctgccctttctgctggccacactgggcaccacagccctcaacaacagcaaccccaaggactactgctacagcgcccgcatccgcagcactgtcctgcagggcctgccctttgggggcgtccccaccgtgctggctctcgacttcatgtgcttccttgcactgctgttcttattctctatcctccggaaggtggcctgggactatgggcggctggccttggtgacagatgcagacagtgtggcttcagctatgcacggggacagccatgaccggtatgagcgtctcacctctgtctccagctccgttgactttgaccaaagggacaatggtttctgttcctggctgacagccatcttcaggataaaggatgatgagatccgggacaaatgtgggggcgatgccgtgcactacctgtcctttcagcggcacatcatcgggctgctggtggttgtgggcgtcctctccgtaggcatcgtgctgcctgtcaacttctcaggggacctgctggagaacaatgcctacagctttgggagaaccaccattgccaacttgaaatcagggaacaacctgctatggctgcacacctccttcgccttcctgtatctgctgctcaccgtctacagcatgcgtagacacacctccaagatgcgctacaaggaggatgatctggtgaagcggaccctcttcatcaatggaatctccaaatatgcagagtcagaaaagatcaagaagcattttgaggaagcctaccccaactgcacagttctcgaagcccgcccgtgttacaacgtggctcgcctaatgttcctcgatgcagagaggaagaaggccgagcggggaaagctgtacttcacaaacctccagagcaaggagaacgtgcctaccatgatcaaccccaagccctgtggccacctctgctgctgtgtggtgcgaggctgtgagcaggtggaggccattgagtactacacaaagctggagcagaagctgaaggaagactacaagcgggagaaggagaaggtgaatgagaagcctcttggcatggcctttgtcaccttccacaatgagactatcaccgccatcatcctgaaggacttcaacgtgtgtaaatgccagggctgcacctgccgtggggagccacgcccctcatcctgcagcgagtccctgcacatctccaactggaccgtgtcctatgcccctgaccctcagaacatctactgggagcacctctccatccgaggcttcatctggtggctgcgctgcctggtcatcaatgtcgtcctcttcatcctcctcttcttcctcaccactccagccatcatcatcaccaccatggacaagttcaacgtcaccaagcctgtggagtacctcaacaaccccatcatcacccagttcttccccaccctgctgctgtggtgcttctcggccctccttcccaccatcgtctactactcagccttctttgaagcccactggacacgctctggggagaacaggacaaccatgcacaagtgctacactttcctcatcttcatggtgctgctcctaccctcgctgggactgagcagcctggacctcttcttccgctggctctttgataagaaattcttggctgaggcagctattcggtttgagtgtgtgttcctgcccgacaacggcgccttcttcgtgaactacgtcattgcctcagcctttatcggcaacgccatggacctgctgcgcatcccaggcctgctcatgtacatgatccggctctgcctggcgcgctcggccgccgagaggcgcaacgtgaagcggcatcaggcctacgagttccagtttggcgcagcctacgcctggatgatgtgcgtcttcacggtggtcatgacctacagtatcacctgccccatcatcgtgcccttcgggctcatgtacatgctgctgaagcacctggtagacaggtacaatctctactacgcctacctgccggccaagctggacaagaagatccactcgggggctgtgaaccaggtggtggccgcgcccatcctctgcctcttctggctgctcttcttttccaccatgcgcacggggttcctagctcccacgtctatgttcacatttgtggtcctggtcatcaccatcgtcatctgtctctgccacgtctgctttggacacttcaaatacctcagtgcccacaactacaagattgagcacacggagacagatactgtggaccccagaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttccagtcttgcgaggacagcctcatagagaatgagattcaccagtaaggggagggaggggccctggaggccacatcctgccccaccccacccccactcccacggacactaaaacgctaataatttattagatctaaagccccttcctccccagcccctgctttcattaaggtatttaaacttgggggtttcactgctctcccccatgatggagggagggagccccccaacctcagtgaggagagccccgagccggccccggggcaaagaggggtgcagagggagttcccccagatcagtaccccccacccctccccagctagtagcatgaccaggagagggttaatgagagccaagaggagtacctggtgcacctggtgccggtggctggagacctggggggcaggtggatctggggctgttcccccccctccgttttttccaccccacagttcctcctgggatctggccctccagggaagtggagcctccagcccctaggggatgcatgaggggggagggggtgctgagtgggaggaagagtcaggctcacagctggggtggcctgggggtgggggtgggcaaggctgacactggaaaatgggtttttgcactgttttttttttggtttttttgttcttttttgtttttttcctttaaaataaaaacaaagaaaagctctgaaaaaaaaaa

SEQ ID NO: 361769 - DNA, 4248 bp, Homo sapiens
gccgcccagcgactccccctccccctcccccagccccgccccgccccaacccggggctccgagccggagccgagtctgcgcctgggggaggaccatgcggcagtagcagccatgctgccctttctgctggccacactgggcaccacagccctcaacaacagcaaccccaaggactactgctacagcgcccgcatccgcagcactgtcctgcagggcctgccctttgggggcgtccccaccgtgctggctctcgacttcatgtgcttccttgcactgctgttcttattctctatcctccggaaggtggcctgggactatgggcggctggccttggtgacagatgcagacaggcttcggcggcaggagagggaccgagtggaacaggaatatgtggcttcagctatgcacggggacagccatgaccggtatgagcgtctcacctctgtctccagctccgttgactttgaccaaagggacaatggtttctgttcctggctgacagccatcttcaggataaaggatgatgagatccgggacaaatgtgggggcgatgccgtgcactacctgtcctttcagcggcacatcatcgggctgctggtggttgtgggcgtcctctccgtaggcatcgtgctgcctgtcaacttctcaggggacctgctggagaacaatgcctacagctttgggagaaccaccattgccaacttgaaatcagggaacaacctgctatggctgcacacctccttcgccttcctgtatctgctgctcaccgtctacagcatgcgtagacacacctccaagatgcgctacaaggaggatgatctggtgaagcggaccctcttcatcaatggaatctccaaatatgcagagtcagaaaagatcaagaagcattttgaggaagcctaccccaactgcacagttctcgaagcccgcccgtgttacaacgtggctcgcctaatgttcctcgatgcagagaggaagaaggccgagcggggaaagctgtacttcacaaacctccagagcaaggagaacgtgcctaccatgatcaaccccaagccctgtggccacctctgctgctgtgtggtgcgaggctgtgagcaggtggaggccattgagtactacacaaagctggagcagaagctgaaggaagactacaagcgggagaaggagaaggtgaatgagaagcctcttggcatggcctttgtcaccttccacaatgagactatcaccgccatcatcctgaaggacttcaacgtgtgtaaatgccagggctgcacctgccgtggggagccacgcccctcatcctgcagcgagtccctgcacatctccaactggaccgtgtcctatgcccctgaccctcagaacatctactgggagcacctctccatccgaggcttcatctggtggctgcgctgcctggtcatcaatgtcgtcctcttcatcctcctcttcttcctcaccactccagccatcatcatcaccaccatggacaagttcaacgtcaccaagcctgtggagtacctcaacaaccccatcatcacccagttcttccccaccctgctgctgtggtgcttctcggccctccttcccaccatcgtctactactcagccttctttgaagcccactggacacgccccatgggagggtgcaacaaagcttccaactcctggagggggcagaagagagaggatctggcggggttaccccaaaggcacccacaaggtgtcttgggtgtgtatacatggtagaagtccctggggtctgtgttggtgttcactctctggtaacctgtttggatgctaagatcaccctcaaggtatatttggggcttggggctccacattctggtagtttctatgggggtgtcttgtgcccatattctgggactaactgtgggcgtctctggagttccacttgggaggtttggggaaccatctctagggaggtcttggtgatacttagggagtgtcttggaggctactaggggtatccctgaaggtctctagagcccatatttttgggtatgtgtaggaggctcttgaccttataactctgggggtgtctgtgggcggggaggctaaaggactcacactttgggatgtttagcagtacaagttctgggaacatctctaaaatttcaggcttttattcagagatgtaactgtggagttctgtatgggcatcttctctgggaatcatgtgaggatatattgaaggtcatgcaccatggctgtgggcacaaactctaggggttttgctgtaggccatctgtggtgatctttgagtcacacttggggcatctcaggcactgataaaggttcctgggctcccccagagatgttgcgggaagggtctcaaagcttgtttgtggaggtatctgaggctcatgtcacactctgggggtaactcgagttatggtctaagtgggggaatcttctgggtgttcctggggctgtcagcctttgggttctttgagggtctcattgggttgtctttgggggtcctggacagttctcccctgaacattctagcagccttaggtggtcttgagcactctctccatgggtctttatggggcacaagttcttggagctgtctgttgccactctgtatgtctctggggggaacagggcacaggtgcttggggcgctaagctgggggtgtccacatggaagaagcatgttggtggtggaggtgttgggtgctgtagttctggcagtgggcgggcggccaccgggtcaccccaagggtgcagtgctggagcacctggtgcccgcaggtgtgtgttcctgcccgacaacggcgccttcttcgtgaactacgtcattgcctcagcctttatcggcaacgccatggacctgctgcgcatcccaggcctgctcatgtacatgatccggctctgcctggcgcgctcggccgccgagaggcgcaacgtgaagcggcatcaggcctacgagttccagtttggcgcagcctacgcctggatgatgtgcgtcttcacggtggtcatgacctacagtatcacctgccccatcatcgtgcccttcgggctcatgtacatgctgctgaagcacctggtagacaggtacaatctctactacgcctacctgccggccaagctggacaagaagatccactcgggggctgtgaaccaggtggtggccgcgcccatcctctgcctcttctggctgctcttcttttccaccatgcgcacggggttcctagctcccacgtctatgttcacatttgtggtcctggtcatcaccatcgtcatctgtctctgccacgtctgctttggacacttcaaatacctcagtgcccacaactacaagattgagcacacggagacagatactgtggaccccagaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttccagtcttgcgaggacagcctcatagagaatgagattcaccagtaaggggagggaggggccctggaggccacatcctgccccaccccacccccactcccacggacactaaaacgctaataatttattagatctaaagccccttcctccccagcccctgctttcattaaggtatttaaacttgggggtttcactgctctcccccatgatggagggagggagccccccaacctcagtgaggagagccccgagccggccccggggcaaagaggggtgcagagggagttcccccagatcagtaccccccacccctccccagctagtagcatgaccaggagagggttaatgagagccaagaggagtacctggtgcacctggtgccggtggctggagacctggggggcaggtggatctggggctgttcccccccctccgttttttccaccccacagttcctcctgggatctggccctccagggaagtggagcctccagcccctaggggatgcatgaggggggagggggtgctgagtgggaggaagagtcaggctcacagctggggtggcctgggggtgggggtgggcaaggctgacactggaaaatgggtttttgcactgttttttttttggtttttttgttcttttttgtttttttcctttaaaataaaaacaaagaaaagctctgaaaaaaaaaa

SEQ ID NO: 361770 - DNA, 2406 bp, Homo sapiens
ttcccagccacttgggaggctgaggtgggagggtcactttagcctgggagcttgaggctccagtgagctgagattccaccactacactccagcctgggcatcagagcgagacgctgtttccaaaaaaaaaaaaatgcttagaggagcagtgcctggcttgtaggaagccccaagtcagcgtgggctggatgctgcaggccccagcctggctttccaactagaggccctgtccctaaccctcccacaaaggtggaggccattgagtactacacaaagctggagcagaagctgaaggaagactacaagcgggagaaggagaaggtgaatgagaagcctcttggcatggcctttgtcaccttccacaatgagactatcaccgccatcatcctgaaggacttcaacgtgtgtaaatgccagggctgcacctgccgtggggagccacgcccctcatcctgcagcgagtccctgcacatctccaactggaccgtgtcctatgcccctgaccctcagaacatctactgggagcacctctccatccgaggcttcatctggtggctgcgctgcctggtcatcaatgtcgtcctcttcatcctcctcttcttcctcaccactccagccatcatcatcaccaccatggacaagttcaacgtcaccaagcctgtggagtacctcaacaaccccatcatcacccagttcttccccaccctgctgctgtggtgcttctcggccctccttcccaccatcgtctactactcagccttctttgaagcccactggacacgctctggggagaacaggacaaccatgcacaagtgctacactttcctcatcttcatggtgctgctcctaccctcgctgggactgagcagcctggacctcttcttccgctggctctttgataagaaattcttggctgaggcagctattcggtttgagtgtgtgttcctgcccgacaacggcgccttcttcgtgaactacgtcattgcctcagcctttatcggcaacgccatggacctgctgcgcatcccaggcctgctcatgtacatgatccggctctgcctggcgcgctcggccgccgagaggcgcaacgtgaagcggcatcaggcctacgagttccagtttggcgcagcctacgcctggatgatgtgcgtcttcacggtggtcatgacctacagtatcacctgccccatcatcgtgcccttcgggctcatgtacatgctgctgaagcacctggtagacaggtacaatctctactacgcctacctgccggccaagctggacaagaagatccactcgggggctgtgaaccaggtggtggccgcgcccatcctctgcctcttctggctgctcttcttttccaccatgcgcacggggttcctagctcccacgtctatgttcacatttgtggtcctggtcatcaccatcgtcatctgtctctgccacgtctgctttggacacttcaaatacctcagtgcccacaactacaagattgagcacacggagacagatactgtggaccccagaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttccagtcttgcgaggacagcctcatagagaatgagattcaccagtaaggggagggaggggccctggaggccacatcctgccccaccccacccccactcccacggacactaaaacgctaataatttattagatctaaagccccttcctccccagcccctgctttcattaaggtatttaaacttgggggtttcactgctctcccccatgatggagggagggagccccccaacctcagtgaggagagccccgagccggccccggggcaaagaggggtgcagagggagttcccccagatcagtaccccccacccctccccagctagtagcatgaccaggagagggttaatgagagccaagaggagtacctggtgcacctggtgccggtggctggagacctggggggcaggtggatctggggctgttcccccccctccgttttttccaccccacagttcctcctgggatctggccctccagggaagtggagcctccagcccctaggggatgcatgaggggggagggggtgctgagtgggaggaagagtcaggctcacagctggggtggcctgggggtgggggtgggcaaggctgacactggaaaatgggtttttgcactgttttttttttggtttttttgttcttttttgtttttttcctttaaaataaaaacaaagaaaagctctgaaaaaaaaaa

SEQ ID NO: 361771 - DNA, 2937 bp, Homo sapiens
gccgcccagcgactccccctccccctcccccagccccgccccgccccaacccggggctccgagccggagccgagtctgcgcctgggggaggaccatgcggcagtagcagccatgctgccctttctgctggccacactgggcaccacagccctcaacaacagcaaccccaaggactactgctacagcgcccgcatccgcagcactgtcctgcagggcctgccctttgggggcgtccccaccgtgctggctctcgacttcatgtgcttccttgcactgctgttcttattctctatcctccggaaggtggcctgggactatgggcggctggccttggtgacagatgcagacaggcttcggcggcaggagagggaccgagtggaacaggaatatgtggcttcagctatgcacggggacagccatgaccggtatgagcgtctcacctctgtctccagctccgttgactttgaccaaagggacaatggtttctgttcctggctgacagccatcttcaggataaaggatgatgagatccgggacaaatgtgggggcgatgccgtgcactacctgtcctttcagcggcacatcatcgggctgctggtggttgtgggcgtcctctccgtaggcatcgtgctgcctgtcaacttctcaggggacctgctggagaacaatgcctacagctttgggagaaccaccattgccaacttgaaatcagggaacaacctgctatggctgcacacctccttcgccttcctgtatctgctgctcaccgtctacagcatgcgtagacacacctccaagatgcgctacaaggaggatgatctggtgaagcggaccctcttcatcaatggaatctccaaatatgcagagtcagaaaagatcaagaagcattttgaggaagcctaccccaactgcacagttctcgaagcccgcccgtgttacaacgtggctcgcctaatgttcctcgatgcagagaggaagaaggccgagcggggaaagctgtacttcacaaacctccagagcaaggagaacgtgcctaccatgatcaaccccaagccctgtggccacctctgctgctgtgtggtgcgaggctgtgagcaggtggaggccattgagtactacacaaagctggagcagaagctgaaggaagactacaagcgggagaaggagaaggtgaatgagaagcctcttggcatggcctttgtcaccttccacaatgagactatcaccgccatcatcctgaaggacttcaacgtgtgtaaatgccagggctgcacctgccgtggggagccacgcccctcatcctgcagcgagtccctgcacatctccaactggaccgtgtcctatgcccctgaccctcagaacatctactgggagcacctctccatccgaggcttcatctggtggctgcgctgcctggtcatcaatgtcgtcctcttcatcctcctcttcttcctcaccactccagccatcatcatcaccaccatggacaagttcaacgtcaccaagcctgtggagtacctcaacaaccccatcatcacccagttcttccccaccctgctgctgtggtgcttctcggccctccttcccaccatcgtctactactcagccttctttgaagcccactggacacgctctggggagaacaggacaaccatgcacaagtgctacactttcctcatcttcatggtgctgctcctaccctcgctgggactgagcagcctggacctcttcttccgctggctctttgataagaaattcttggctgaggcagctattcggtttgagtgtgtgttcctgcccgacaacggcgccttcttcgtgaactacgtcattgcctcagcctttatcggcaacgccatggacctgctgcgcatcccaggcctgctcatgtacatgatccggctctgcctggcgcgctcggccgccgagaggcgcaacgtgaagcggcatcaggcctacgagttccagtttggcgcagcctacgcctggatgatgtgcgtcttcacggtggtcatgacctacagtatcacctgccccatcatcgtgcccttcgggctcatgtacatgctgctgaagcacctggtagacaggtacaatctctactacgcctacctgccggccaagctggacaagaagatccactcgggggctgtgaaccaggtggtggccgcgcccatcctctgcctcttctggctgctcttcttttccaccatgcgcacggggttcctagctcccacgtctatgttcacatttgtggtcctggtcatcaccatcgtcatctgtctctgccacgtctgctttggacacttcaaatacctcagtgcccacaactacaagattgagcacacggagacagatactgtggaccccagaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttccagtcttgcgaggacagcctcatagagaatgagattcaccagtaaggggagggaggggccctggaggccacatcctgccccaccccacccccactcccacggacactaaaacgctaataatttattagatctaaagccccttcctccccagcccctgctttcattaaggtatttaaacttgggggtttcactgctctcccccatgatggagggagggagccccccaacctcagtgaggagagccccgagccggccccggggcaaagaggggtgcagagggagttcccccagatcagtaccccccacccctccccagctagtagcatgaccaggagagggtttactcctcttggctctcattaaccgtcgagc

SEQ ID NO: 361772 - DNA, 2935 bp, Homo sapiens
ttaccgaaagagttcgtgtcctatgccccttatctcagaagcatatactgatagcaccgtctgcatccgaggcataatctggtgagctagcgctgccttgtcatcacatgtcgtgctcttcatccttctcttcttccttagcactccagcctcatcattatcaccatggacagttcatcgtcaccaatccttgctggggtaccgtccacaaccttcgtcatcacccgtcttcttccccaccctgctgctgtggtgcttctcggccctccttcccaccatcgtctactactcagccttctttgaagcccactggacacgccccatgggagggtgcaacaaagcttccaactcctggagggggcagaagagagaggatctggcggggttaccccaaaggcacccacaaggtgtcttgggtgtgtatacatggtagaagtccctggggtctgtgttggtgttcactctctggtaacctgtttggatgctaagatcaccctcaaggtatatttggggcttggggctccacattctggtagtttctatgggggtgtcttgtgcccatattctgggactaactgtgggcgtctctggagttccacttgggaggtttggggaaccatctctagggaggtcttggtgatacttagggagtgtcttggaggctactaggggtatccctgaaggtctctagagcccatatttttgggtatgtgtaggaggctcttgaccttataactctgggggtgtctgtgggcggggaggctaaaggactcacactttgggatgtttagcagtacaagttctgggaacatctctaaaatttcaggcttttattcagagatgtaactgtggagttctgtatgggcatcttctctgggaatcatgtgaggatatattgaaggtcatgcaccatggctgtgggcacaaactctaggggttttgctgtaggccatctgtggtgatctttgagtcacacttggggcatctcaggcactgataaaggttcctgggctcccccagagatgttgcgggaagggtctcaaagcttgtttgtggaggtatctgaggctcatgtcacactctgggggtaactcgagttatggtctaagtgggggaatcttctgggtgttcctggggctgtcagcctttgggttctttgagggtctcattgggttgtctttgggggtcctggacagttctcccctgaacattctagcagccttaggtggtcttgagcactctctccatgggtctttatggggcacaagttcttggagctgtctgttgccactctgtatgtctctggggggaacagggcacaggtgcttggggcgctaagctgggggtgtccacatggaagaagcatgttggtggtggaggtgttgggtgctgtagttctggcagtgggcgggcggccaccgggtcaccccaagggtgcagtgctggagcacctggtgcccgcaggtgtgtgttcctgcccgacaacggcgccttcttcgtgaactacgtcattgcctcagcctttatcggcaacgccatggacctgctgcgcatcccaggcctgctcatgtacatgatccggctctgcctggcgcgctcggccgccgagaggcgcaacgtgaagcggcatcaggcctacgagttccagtttggcgcagcctacgcctggatgatgtgcgtcttcacggtggtcatgacctacagtatcacctgccccatcatcgtgcccttcgggctcatgtacatgctgctgaagcacctggtagacaggtacaatctctactacgcctacctgccggccaagctggacaagaagatccactcgggggctgtgaaccaggtggtggccgcgcccatcctctgcctcttctggctgctcttcttttccaccatgcgcacggggttcctagctcccacgtctatgttcacatttgtggtcctggtcatcaccatcgtcatctgtctctgccacgtctgctttggacacttcaaatacctcagtgcccacaactacaagattgagcacacggagacagatactgtggaccccagaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttccagtcttgcgaggacagcctcatagagaatgagattcaccagtaaggggagggaggggccctggaggccacatcctgccccaccccacccccactcccacggacactaaaacgctaataatttattagatctaaagccccttcctccccagcccctgctttcattaaggtatttaaacttgggggtttcactgctctcccccatgatggagggagggagccccccaacctcagtgaggagagccccgagccggccccggggcaaagaggggtgcagagggagttcccccagatcagtaccccccacccctccccagctagtagcatgaccaggagagggttaatgagagccaagaggagtacctggtgcacctggtgccggtggctggagacctggggggcaggtggatctggggctgttcccccccctccgttttttccaccccacagttcctcctgggatctggccctccagggaagtggagcctccagcccctaggggatgcatgaggggggagggggtgctgagtgggaggaagagtcaggctcacagctggggtggcctgggggtgggggtgggcaaggctgacactggaaaatgggtttttgcactgttttttttttggtttttttgttcttttttgtttttttcctttaaaataaaaacaaagaaaagctctgaaaaaaaaaa

SEQ ID NO: 361773 - DNA, 1101 bp, Homo sapiens
gccgcccagcgactccccctccccctcccccagccccgccccgccccaacccggggctccgagccggagccgagtctgcgcctgggggaggaccatgcggcagtagcagccatgctgccctttctgctggccacactgggcaccacagccctcaacaacagcaaccccaaggactactgctacagcgcccgcatccgcagcactgtcctgcagggcctgccctttgggggcgtccccaccgtgctggctctcgacttcatgtgcttccttgcactgctgttcttattctctatcctccggaaggtggcctgggactatgggcggctggccttggtgacagatgcagacaggcttcggcggcaggagagggaccgagtggaacaggaatatgtggcttcagctatgcacggggacagccatgaccggtatgagcgtctcacctctgtctccagctccgttgactttgaccaaagggacaatggtttctgttcctggctgacagccatcttcaggataaaggatgatgagatccgggacaaatgtgggggcgatgccgtgcactacctgtcctttcagcggcacatcatcgggctgctggtggttgtgggcgtcctctccgtaggcatcgtgctgcctgtcaacttctcaggggacctgctggagaacaatgcctacagctttgggagaaccaccattgccaacttgaaatcagggaacaacctgctatggctgcacacctccttcgccttcctgtatctgctgctcaccgtctacagcatgcgtagacacacctccaagatgcgctacaaggaggatgatctggtgaagcggaccctcttcatcaatggaatctccaaatatgcagagtcagaaaagatcaagaagcattttgagtgagtaagccacgcttccccctaccctcaagccctgctgcagagccttctctgcctttgaactctaagaacatccttataccctagcctggagctctgccgtgggtgggatagagattagatccaggaagaaatgtccgattccagggtggtttagcacttgggtcgggtgataggcccctttaagaacaggaaaaataagacaaaa

SEQ ID NO: 361774 - DNA, 368 bp, Homo sapiens
caggggtgggtatgcttgagagacattgccagccccatgggagggtgcaacaaagcttccaactcctggagggggcagaagagagaggatctggcggggttaccccaaaggcacccacaaggtgtcttgggtgtgtatacatggtagaagtccctggggtctgtgttggtgttcactctctggtaacctgtttggatgctaagatcaccctcaaggtatatttggggcttggggctccacattctggtagtttctatgggggtgtcttgtgcccatattctgggactaactgtgggcgtctctggagttccacttgggaggtttggggaaccatctctagggaggtcttggtgatacttagggagtgt

SEQ ID NO: 361775 - DNA, 369 bp, Homo sapiens
ctacaagaccaatgtagaaatgtacttttaagaagtgattaggccctatgaggtggctcacgcctgttattacagccctttgggaggccaaggcaggaggatcccgtgagcccaggagtttgagactgcagtgagttatgattgtgccactgcactccaacctgggcaacagagtaagaccctgtctcaaaaaacaaaagttttttttaaaacttagcattttataagagtggaacaattttaatagtcaaatgcattatagtatgggaatggtgaaattaatgataatctatatggtggatacaacttctaaaaatcattttaaaaatgtactgacataagtataatataatattaagagaaaaatta

SEQ ID NO: 361776 - DNA, 937 bp, Homo sapiens
ataaaaattggtcagtgtgtgttctccaaaaaaaaatcttgataatggggaaaatcagagattagacaggaaaagaagatattgtggctaagatttgactgcacttacgctttcatctctcttgcctttttattctctgagaaggtccctaaaattgtagttaatgctgctttattattatgttcagtgacttaacttcaatgtgtatctaatatcactgaacagtaactagggtccgaacatttgctcattaactcctgaaagtagtctgttgtgatacgtcaccaaacaaaggtttcaaatgtagaagcatgaaaggttctttaattatttgatgtgaattagttaaaagttccttgaaattttattttggatgatcttaactcacttttttctaatgaaatttttgctttcaactggtagtaactggtcctgggcattcagatttttatatttatgtatgtatgcaagatacactattctcttttgagaaaatgttgtcttagctaatttctgggatttgtgaaaggaaatgtaatatgttaatagctattattggcactctatgttacaatattaaggatctaaatagattcccacttagccacgatgcttttcttaagcataattcatctctacgtaaatatcccatatgaaagaaaatttagagccctccatttaaaaaagctttcttgctctgcataaaacttgaaaataattaatttcaaagttatattgatattaaaacatagattcagtcttgtcttaaaagtgtattacaatttatttcttgccatttttgtgtaaaatttacagaaagagtgttacaccgtgcgctccaaaggtaatgtctcattactctaaggctctctctctctttgcctttatctctttaattctgttgttatgtgcattgaaacattttaagaaaaaaaaa

SEQ ID NO: 361777 - DNA, 1096 bp, Homo sapiens
gtcaatctgtgctcatggatgggcttctcagcaatataattctttttattttttatttttctcttcagttttccaaaatgggtcggatagtaagcagtacaatatcatgtgtccctgtaaggaaggttcccaagtaccaagcgaaatctgaatgttaccagactctttaccctaaaatggttaagaaccattgttttaaaggcagaaaactgaggcccagtttgcataatcgtttccttttatgaagcagatttcaagttctcattccattctagttgcttcatacaacaaacagtttggttttattttcaggtctgtggacatgtcattgattacagttaattgtcttgattactgtttatagcttaattatcaaaccagttgtttcttgaatttgtattatgacagggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaagggtacgtgtaaaacaccaatgtactcttacctaaaaacaaacactctggaatgggaaaagtatgtataattctataaactcaattttattacctgttattgaaaaaggatagcactttttaaactttaaattgaaatctggcaaatctaggagtaggtagcataggcatttcatttcaaagatttgtgtgttttcagttttcgggtgaaaatagtcctaagaactctttttttaagagatagggtcttgctctgttatccaggctggaatacagtggcacaattatagctcactgcatcctccacctcctgggctcaaga

SEQ ID NO: 361778 - DNA, 781 bp, Homo sapiens
taaaaattaaacacctaaaaagattattgaacttcttccatgtatagcacattaggcaagctaattggaaatttggaggaagtaagctagagatttttctaaaattttattagttttccctgaaagttaataatttaaatatcatttagccaaagtatgttactactaaaagtgactgttctaaggctgtttgtgtgaagtattaaatatatgttcttttcctcaaggctttaattagtatcttttggcctttttatgcttttgttatttgattagcttaaatttttcttttctgagtgttcagtcaagttatctgtactgaccagaagaggaatttcatcttttgctttctatttattacttgaacattactttaaagtgacttataattggagactgacaaatttgtgttttcttcaaacagatgaaaactttattctcaaacatgacagagcgttccttttatcaatggcaaatcgagggaaacataccaatggttcccagtttttcatgtgagtaggcataattcagagatgagcttttcttaaacagagaagcgctgttcataagaaagatggtatagttaaaccaagtttaatgctaaaattctgtcagctttatttttattattaatttctaatatcatagtaacttataaggtctaacaactgcctcagcattcagcatatatcctgaattggaagaatgggacttaaaaaatttaaaacttatacattgttttcaaaatatgccgtcatcttcagaaaagatgacggcatat

SEQ ID NO: 361779 - DNA, 775 bp, Homo sapiens
gtactctcgcggtatttgtcccgactctcgcggggtttagcgtggcattgggaggcccggcctgggggaggagacggcgttccgttagcggcgttggggtttggctgcagtggcagtgctttctcttctgctcacggggacccgctcaggctggaggccagccagctcttgccgccacctcggtcgcgatgggggcgcaggaccggccgcagtgccacttcgacatcgagatcaaccgggagccggttggtcgcattatgtttcagctcttctcagacatatgtccaaaaacatgcaaaaacttcctttgcttgtgctcaggagagaaaggccttgggaaaacaactgggaagaagttatgttataaaggttctacgttccatcgtgtggttaaaaactttatgattcagggtggggacttcagtgaaggtaatggaaaaggtggagaatcaatttatggtggatattttaaagagaatgtggtcttttgcaaaatgaaaaggtaagagaacgaagctcagtaacacaaactccaattctgttcccttgcacccttcctaataaatttatggacagtctgggtcaggttgtggctggatttctatattgcttgaagacttggaaaattctgtgtattatttcatacatgcttctgtatcttttttcatttcccaatgggttattaatttcacatcagagaaaagagtctagttgtggggttttttttcccctaaaccaagcaatttctttgaataaaagttgaaatttcgttttt

SEQ ID NO: 361780 - DNA, 633 bp, Homo sapiens
taaaaattaaacacctaaaaagattattgaacttcttccatgtatagcacattaggcaagctaattggaaatttggaggaagtaagctagagatttttctaaaattttattagttttccctgaaagttaataatttaaatatcatttagccaaagtatgttactactaaaagtgactgttctaaggctgtttgtgtgaagtattaaatatatgttcttttcctcaaggctttaattagtatcttttggcctttttatgcttttgttatttgattagcttaaatttttcttttctgagtgttcagtcaagttatctgtactgaccagaagaggaatttcatcttttgctttctatttattacttgaacattactttaaagtgacttataattggagactgacaaatttgtgttttcttcaaacagatgaaaactttattctcaaacatgacagagcgttccttttatcaatggcaaatcgagggaaacataccaatggttcccagtttttcataaagagtgttacaccgtgcgctccaaaggtaatgtctcattactctaaggctctctctctctttgcctttatctctttaattctgttgttatgtgcattgaaacattttaagaaaaaaaaa

SEQ ID NO: 361781 - DNA, 558 bp, Homo sapiens
ggtttttttttttaagtgttttgttttgttgttttggagttgagagtaactttaatttttatgtgtattcatgctgtgtatttatggctacaagtcaaactgatttcatatgtatgcatacatatagtctaatagagatgattgtaattcattataatcttgagttttttaaattagtaagatggctactattgctgttttggggtttttaaggttagatatatatcatgtttaactttttcccctatctttttatctttacttctttgttctctacatgctgtgtttaaacctttctgctctcttcacctgaacacatcgtgtttgacatcatctttgtgttgatgtttattacatagtaccacaaagcctgctccacacctggatgggtaagagttacattcttactacattggggaagtgtttgggtggccagccataaagagagattggaccatggttgagccctcaagggagcgctcttgatgtctggcttaatctcatagcaaaagctattccttaggatcacagaatatacttgttttgagaccccatggc

SEQ ID NO: 361782 - DNA, 7512 bp, Homo sapiens
gtactctcgcggtatttgtcccgactctcgcggggtttagcgtggcattgggaggcccggcctgggggaggagacggcgttccgttagcggcgttggggtttggctgcagtggcagtgctttctcttctgctcacggggacccgctcaggctggaggccagccagctcttgccgccacctcggtcgcgatgggggcgcaggaccggccgcagtgccacttcgacatcgagatcaaccgggagccggttggtcgcattatgtttcagctcttctcagacatatgtccaaaaacatgcaaaaacttcctttgcttgtgctcaggagagaaaggccttgggaaaacaactgggaagaagttatgttataaaggttctacgttccatcgtgtggttaaaaactttatgattcagggtggggacttcagtgaaggtaatggaaaaggtggagaatcaatttatggtggatattttaaagatgaaaactttattctcaaacatgacagagcgttccttttatcaatggcaaatcgagggaaacataccaatggttcccagtttttcattaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaaatgcaatctgattgcatttagacaatgtaggttgtagtcactttagatggaaaattacctcacatctgttttcttcagtattacttaagattgtttatttagtggtagagagttttttttttcagcctagaggcagctattttaccatctggtatttatggtctaaatgcaatca

SEQ ID NO: 361783 - DNA, 7134 bp, Homo sapiens
ggtttttttttttaagtgttttgttttgttgttttggagttgagagtaactttaatttttatgtgtattcatgctgtgtatttatggctacaagtcaaactgatttcatatgtatgcatacatatagtctaatagagatgattgtaattcattataatcttgagttttttaaattagtaagatggctactattgctgttttggggtttttaaggttagatatatatcatgtttaactttttcccctatctttttatctttacttctttgttctctacatgctgtgtttaaacctttctgctctcttcacctgaacacatcgtgtttgacatcatctttgtgttgatgtttattacatagtaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361784 - DNA, 7079 bp, Homo sapiens
ggtttttttttttaagtgttttgttttgttgttttggagttgagagtaactttaatttttatgtgtattcatgctgtgtatttatggctacaagtcaaactgatttcatatgtatgcatacatatagtctaatagagatgattgtaattcattataatcttgagttttttaaattagtaagatggctactattgctgttttggggtttttaaggttagatatatatcatgtttaactttttcccctatctttttatctttacttctttgttctctacatgctgtgtttaaacctttctgctctcttcacctgaacacatcgtgtttgacatcatctttgtgttgatgtttattacatagtaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtaaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361785 - DNA, 6800 bp, Homo sapiens
ggtttttttttttaagtgttttgttttgttgttttggagttgagagtaactttaatttttatgtgtattcatgctgtgtatttatggctacaagtcaaactgatttcatatgtatgcatacatatagtctaatagagatgattgtaattcattataatcttgagttttttaaattagtaagatggctactattgctgttttggggtttttaaggttagatatatatcatgtttaactttttcccctatctttttatctttacttctttgttctctacatgctgtgtttaaacctttctgctctcttcacctgaacacatcgtgtttgacatcatctttgtgttgatgtttattacatagtaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361786 - DNA, 7828 bp, Homo sapiens
aacttcgttcagcctgatctgaagaagtgtctggttattcggcgtgtgcacacgccgagtaaccataccacaatgaccttaggcttaatattctccagttctccattcgttagtctccacaaaacatggcctggtgtatctcccccaatttccaaattcagtgcatgaagtggggaaaaaagctctcgccatatctcatattgctgcattaactgcaccatggagtctcccacggacagtacatcaggctctttgtctttacagtccaaaacaaatctgttgtgctggtttgaagaagaaaaaaaaattattaactggcacttctggctgggtgtggtggcccatgcttgtactctcttcatttagggaggcccaggcaggaggattgcttgaacccaggagtttgagaccagcctgggcaatatagcaagaccctgtctacaaaaaacaatttttttttttttttttttttttccaggagagaaaggccttgggaaaacaactgggaagaagttatgttataaaggttctacgttccatcgtgtggttaaaaactttatgattcagggtggggacttcagtgaaggtaatggaaaaggtggagaatcaatttatggtggatattttaaaggtaaggcttaatattttacggtcttttgtttcagttctgatattaaagcaagtttgatcatatacttttaatgagaagaggtttacttatagttcactttttgcatgaaactaatgctgcatgaaaatactttatttgcatgaatttggggataaattatattgtaatatataatttttaattgacaagattaattaaggctaactttatggttaaacatgactttcagcatggaggttaggcaactatatacatgaaactcctatcttcctgcctaaaactgtcaacatattcttttgtttatagagaatgtggtcttttgcaaaatgaaaagatgaaaactttattctcaaacatgacagagcgttccttttatcaatggcaaatcgagggaaacataccaatggttcccagtttttcattaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361787 - DNA, 7317 bp, Homo sapiens
aagctatcaaaaatgatttctgtgttagtatatttttaatgttcattatggcttaaagtaggtgattatttgcaggtaatggaaaaggtggagaatcaatttatggtggatattttaaaggtaaggcttaatattttacggtcttttgtttcagttctgatattaaagcaagtttgatcatatacttttaatgagaagaggtttacttatagttcactttttgcatgaaactaatgctgcatgaaaatactttatttgcatgaatttggggataaattatattgtaatatataatttttaattgacaagattaattaaggctaactttatggttaaacatgactttcagcatggaggttaggcaactatatacatgaaactcctatcttcctgcctaaaactgtcaacatattcttttgtttatagagaatgtggtcttttgcaaaatgaaaagatgaaaactttattctcaaacatgacagagcgttccttttatcaatggcaaatcgagggaaacataccaatggttcccagtttttcattaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361788 - DNA, 7619 bp, Homo sapiens
ataaaaattggtcagtgtgtgttctccaaaaaaaaatcttgataatggggaaaatcagagattagacaggaaaagaagatattgtggctaagatttgactgcacttacgctttcatctctcttgcctttttattctctgagaaggtccctaaaattgtagttaatgctgctttattattatgttcagtgacttaacttcaatgtgtatctaatatcactgaacagtaactagggtccgaacatttgctcattaactcctgaaagtagtctgttgtgatacgtcaccaaacaaaggtttcaaatgtagaagcatgaaaggttctttaattatttgatgtgaattagttaaaagttccttgaaattttattttggatgatcttaactcacttttttctaatgaaatttttgctttcaactggtagtaactggtcctgggcattcagatttttatatttatgtatgtatgcaagatacactattctcttttgagaaaatgttgtcttagctaatttctgggatttgtgaaaggaaatgtaatatgttaatagctattattggcactctatgttacaatattaaggatctaaatagattcccacttagccacgatgcttttcttaagcataattcatctctacgtaaatatcccatatgaaagaaaatttagagccctccatttaaaaaagctttcttgctctgcataaaacttgaaaataattaatttcaaagttatattgatattaaaacatagattcagtcttgtcttaaaagtgtattacaatttatttcttgccatttttgtgtaaaatttacagaaagagtgttacaccgtgcgctccaaagtaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361789 - DNA, 6615 bp, Homo sapiens
ggtttttttttttaagtgttttgttttgttgttttggagttgagagtaactttaatttttatgtgtattcatgctgtgtatttatggctacaagtcaaactgatttcatatgtatgcatacatatagtctaatagagatgattgtaattcattataatcttgagttttttaaattagtaagatggctactattgctgttttggggtttttaaggttagatatatatcatgtttaactttttcccctatctttttatctttacttctttgttctctacatgctgtgtttaaacctttctgctctcttcacctgaacacatcgtgtttgacatcatctttgtgttgatgtttattacatagtaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatactttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361790 - DNA, 6735 bp, Homo sapiens
gtagagacagggtcttccgctatgttgaccaggctggtctctgactcctgtcctcaagcaatcctcccacctaagacccctaaagtactgggattacaggtgtgagccacaatgcctggcctcctggaactcttaaaataaaaaagttaggatcatttaacaattttcctatcaaaattctagtctttgggtttttcactgggttgatattgttctctttgtgaaaatcatataactcttttgagtgagacttgtaagctatcgttaattatgctgttgttttagtaactaattttatgtgcttttattatgaaatgcaaacattatacattttaatcagtgacttggtttgttctaagtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361791 - DNA, 6045 bp, Homo sapiens
gcggccgcctactactactactactgctcgaattcaagcttctaacgatgtacggggacatgtgacaggaagatatcgtgaaataggaccatttacaaccacagaaaaacctctgtatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361792 - DNA, 7146 bp, Homo sapiens
ggtttttttttttaagtgttttgttttgttgttttggagttgagagtaactttaatttttatgtgtattcatgctgtgtatttatggctacaagtcaaactgatttcatatgtatgcatacatatagtctaatagagatgattgtaattcattataatcttgagttttttaaattagtaagatggctactattgctgttttggggtttttaaggttagatatatatcatgtttaactttttcccctatctttttatctttacttctttgttctctacatgctgtgtttaaacctttctgctctcttcacctgaacacatcgtgtttgacatcatctttgtgttgatgtttattacatagtaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361793 - DNA, 3336 bp, Homo sapiens
atcagagattggcagaagcaggaagcagcagaagcaggaagcggcagaagcaggaagcaagcagaagcaggaagcaggcagaagcaggaagcaggcagaagcaggaagcaaggccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361794 - DNA, 3119 bp, Homo sapiens
gtgggatttcactgtattttcaccttgatgggcaaataaatgtctagatatttggtatagcctgtcctgccctgatctataagatgatggtccttcatgtgattaatattaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361795 - DNA, 5853 bp, Homo sapiens
ggtttttttttttaagtgttttgttttgttgttttggagttgagagtaactttaatttttatgtgtattcatgctgtgtatttatggctacaagtcaaactgatttcatatgtatgcatacatatagtctaatagagatgattgtaattcattataatcttgagttttttaaattagtaagatggctactattgctgttttggggtttttaaggttagatatatatcatgtttaactttttcccctatctttttatctttacttctttgttctctacatgctgtgtttaaacctttctgctctcttcacctgaacacatcgtgtttgacatcatctttgtgttgatgtttattacatagtaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtgtgtgtgtgtgcgtggattgtctgataggtgctccaatgtgatctgtggctccccctgtgtgatctaaacactatgcgaacagtggaacgcggattctgcgaaagatatgcatagtggggtgcctgatgtagaagactggcccgacgctacgg

SEQ ID NO: 361796 - DNA, 5704 bp, Homo sapiens
ggtttttttttttaagtgttttgttttgttgttttggagttgagagtaactttaatttttatgtgtattcatgctgtgtatttatggctacaagtcaaactgatttcatatgtatgcatacatatagtctaatagagatgattgtaattcattataatcttgagttttttaaattagtaagatggctactattgctgttttggggtttttaaggttagatatatatcatgtttaactttttcccctatctttttatctttacttctttgttctctacatgctgtgtttaaacctttctgctctcttcacctgaacacatcgtgtttgacatcatctttgtgttgatgtttattacatagtaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtgatcccaaccagttggctttattaaaggttccaagggtgcttgcaagagaaa

SEQ ID NO: 361797 - DNA, 5678 bp, Homo sapiens
  misc_feature (5665)..(5665): n is a, c, g, or t
ggtttttttttttaagtgttttgttttgttgttttggagttgagagtaactttaatttttatgtgtattcatgctgtgtatttatggctacaagtcaaactgatttcatatgtatgcatacatatagtctaatagagatgattgtaattcattataatcttgagttttttaaattagtaagatggctactattgctgttttggggtttttaaggttagatatatatcatgtttaactttttcccctatctttttatctttacttctttgttctctacatgctgtgtttaaacctttctgctctcttcacctgaacacatcgtgtttgacatcatctttgtgttgatgtttattacatagtaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaatacagatgtgggttggggtcccctggagcaggcaggattggcagtaagagatattggccactcaagtctactgtgtgtgtgtccgtgtggttttttttttctatctttactttgaatctgctccccatgtgtgcttaagtcccttagcgctagtctaaccacttgatcacggcgacatcatattgccgcctggtgtcccgttcagctaccccctaccacatccctttgctgccgacatcgcactgggtacagagcccctacctctacccgtctcccacacctcatcgtgcgaagctccacccattccttaccctcctttccacaggcccactgacaccagttcccctctccatccctctgcacttcatcaccctgccagcccctttcattcctgtctttcccccctccttacctcctttcctcttcatgccttcttaccactnctcccccttgccc

SEQ ID NO: 361798 - DNA, 3972 bp, Homo sapiens
ggtttttttttttaagtgttttgttttgttgttttggagttgagagtaactttaatttttatgtgtattcatgctgtgtatttatggctacaagtcaaactgatttcatatgtatgcatacatatagtctaatagagatgattgtaattcattataatcttgagttttttaaattagtaagatggctactattgctgttttggggtttttaaggttagatatatatcatgtttaactttttcccctatctttttatctttacttctttgttctctacatgctgtgtttaaacctttctgctctcttcacctgaacacatcgtgtttgacatcatctttgtgttgatgtttattacatagtaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtcttctcaaccacctccttcttcccggtactttctccagcactacccaagcttacagagctctggtcctgtttccccactcacccacactttactttcgacatctgctttcctgtttactacctctgcttgagatgttccgtccatatcccgcataactcgc

SEQ ID NO: 361799 - DNA, 1081 bp, Homo sapiens
gtactctcgcggtatttgtcccgactctcgcggggtttagcgtggcattgggaggcccggcctgggggaggagacggcgttccgttagcggcgttggggtttggctgcagtggcagtgctttctcttctgctcacggggacccgctcaggctggaggccagccagctcttgccgccacctcggtcgcgatgggggcgcaggaccggccgcagtgccacttcgacatcgagatcaaccgggagccggttggtcgcattatgtttcagctcttctcagacatatgtccaaaaacatgcaaaaacttcctttgcttgtgctcaggagagaaaggccttgggaaaacaactgggaagaagttatgttataaaggttctacgttccatcgtgtggttaaaaactttatgattcagggtggggacttcagtgaaggtaatggaaaaggtggagaatcaatttatggtggatattttaaaggtaaggcttaatattttacggtcttttgtttcagttctgatattaaagcaagtttgatcatatacttttaatgagaagaggtttacttatagttcactttttgcatgaaactaatgctgcatgaaaatactttatttgcatgaatttggggataaattatattgtaatatataatttttaattgacaagattaattaaggctaactttatggttaaacatgactttcagcatggaggttaggcaactatatacatgaaactcctatcttcctgcctaaaactgtcaacatattcttttgtttatagagaatgtggtcttttgcaaaatgaaaaggtaagagaacgaagctcagtaacacaaactccaattctgttcccttgcacccttcctaataaatttatggacagtctgggtcaggttgtggctggatttctatattgcttgaagacttggaaaattctgtgtattatttcatacatgcttctgtatcttttttcatttcccaatgggttattaatttcacatcagagaaaagagtctagttgtggggttttttttcccctaaaccaagcaatttctttgaataaaagttgaaatttcgttttt

SEQ ID NO: 361800 - DNA, 382 bp, Homo sapiens
aagctattgcaaaatggcatgtatctttgaattaatagcttaacataatgtgttttcattattaaaaattctagcttctttgcttatttttaattttcatcacaatcttcttttcctaggaagattcctgatgttgcacccattgtaagtgatcagaaaccatctgtatcaaagtctggacggaagattaaaggaaggggcacaattgtatgtgtgataagactttttttgatattatgtatctaataaaaaatttttacctattttcaaagtcctagcgttaattttagatataatacaaaatctgttcaaggaactaattgtattttccatggttatgggaaggtattgctgttagatcaaagtatactgctgtgtttga

SEQ ID NO: 361801 - DNA, 364 bp, Homo sapiens
atggtgttcttgttcataggtatcacccagttaaatgctttcccattacatcttttaaaaaattaaaatgaattacaaaaatagactttctaatttgttagccctgtttctttctcccatttaaatgtgatatatttaacttgcttactatttttttcctatgtattttatttcagttggtcgcattatgtttcagctcttctcagacatatgtccaaaaacatgcaaaaacttcctttgcttgtgctcaggtaagtgaattattatttccaatgagaagctgtggcttacagttttaccttgctgaacagaatagatattttcctggaagaataatggactcgtgaaattagttttgtgaatt

SEQ ID NO: 361802 - DNA, 470 bp, Homo sapiens
gtgggatttcactgtattttcaccttgatgggcaaataaatgtctagatatttggtatagcctgtcctgccctgatctataagatgatggtccttcatgtgattaatattaggacgtccagcaggagcagatccaggagcagctcatatgatccccacagtcgatccaggtatgaacagggattgggaaaccaccagtggggcagaactgaaagatcttgttttgtaaactgtttgttcaaagtggtattttattgagtaactaaatgcatatatttgtctcctgaaaccataccttttctaaatgaggtctgttcgacaagttttatctgttggcccattgtactccagtgtcaaaaatgacaatatcaaattgtaatggcaggtgtttattgaatataattgcctacagagatccaccaggttcaaactaactcgttaactttgtgatatttttcaatgcagaaaaga

SEQ ID NO: 361803 - DNA, 7337 bp, Homo sapiens
gtactctcgcggtatttgtcccgactctcgcggggtttagcgtggcattgggaggcccggcctgggggaggagacggcgttccgttagcggcgttggggtttggctgcagtggcagtgctttctcttctgctcacggggacccgctcaggctggaggccagccagctcttgccgccacctcggtcgcgatgggggcgcaggaccggccgcagtgccacttcgacatcgagatcaaccgggagccggttggtcgcattatgtttcagctcttctcagacatatgtccaaaaacatgcaaaaacttcctttgcttgtgctcaggagagaaaggccttgggaaaacaactgggaagaagttatgttataaaggttctacgttccatcgtgtggttaaaaactttatgattcagggtggggacttcagtgaaggtaatggaaaaggtggagaatcaatttatggtggatattttaaagatgaaaactttattctcaaacatgacagagcgttccttttatcaatggcaaatcgagggaaacataccaatggttcccagtttttcattaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361804 - DNA, 7618 bp, Homo sapiens
gtactctcgcggtatttgtcccgactctcgcggggtttagcgtggcattgggaggcccggcctgggggaggagacggcgttccgttagcggcgttggggtttggctgcagtggcagtgctttctcttctgctcacggggacccgctcaggctggaggccagccagctcttgccgccacctcggtcgcgatgggggcgcaggaccggccgcagtgccacttcgacatcgagatcaaccgggagccggttggtcgcattatgtttcagctcttctcagacatatgtccaaaaacatgcaaaaacttcctttgcttgtgctcaggagagaaaggccttgggaaaacaactgggaagaagttatgttataaaggttctacgttccatcgtgtggttaaaaactttatgattcagggtggggacttcagtgaaggtaatggaaaaggtggagaatcaatttatggtggatattttaaagatgaaaactttattctcaaacatgacagagcgttccttttatcaatggcaaatcgagggaaacataccaatggttcccagtttttcattaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaagtctgagtctgttcatgttttatctttctgctgacccagccagtgaagacacctcatctcctttggcagctccttttcttctcctagctgagtgttagtggtgggtgtaggaggtggagctagagagaatgtcaggcagagattttaacctacacaggtaagcattaatgatgtttggtcttcctcccctggaaaatccagatttcctctacactttgttgtcatctagttaaaatgacctgcataaagatgtctttgctgagggaggaatatgtcacatc

SEQ ID NO: 361805 - DNA, 7315 bp, Homo sapiens
taaaaattaaacacctaaaaagattattgaacttcttccatgtatagcacattaggcaagctaattggaaatttggaggaagtaagctagagatttttctaaaattttattagttttccctgaaagttaataatttaaatatcatttagccaaagtatgttactactaaaagtgactgttctaaggctgtttgtgtgaagtattaaatatatgttcttttcctcaaggctttaattagtatcttttggcctttttatgcttttgttatttgattagcttaaatttttcttttctgagtgttcagtcaagttatctgtactgaccagaagaggaatttcatcttttgctttctatttattacttgaacattactttaaagtgacttataattggagactgacaaatttgtgttttcttcaaacagatgaaaactttattctcaaacatgacagagcgttccttttatcaatggcaaatcgagggaaacataccaatggttcccagtttttcataaagagtgttacaccgtgcgctccaaagtaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361806 - DNA, 7671 bp, Homo sapiens
gtactctcgcggtatttgtcccgactctcgcggggtttagcgtggcattgggaggcccggcctgggggaggagacggcgttccgttagcggcgttggggtttggctgcagtggcagtgctttctcttctgctcacggggacccgctcaggctggaggccagccagctcttgccgccacctcggtcgcgatgggggcgcaggaccggccgcagtgccacttcgacatcgagatcaaccgggagccggttggtcgcattatgtttcagctcttctcagacatatgtccaaaaacatgcaaaaacttcctttgcttgtgctcaggagagaaaggccttgggaaaacaactgggaagaagttatgttataaaggttctacgttccatcgtgtggttaaaaactttatgattcagggtggggacttcagtgaaggtaatggaaaaggtggagaatcaatttatggtggatattttaaaggtaaggcttaatattttacggtcttttgtttcagttctgatattaaagcaagtttgatcatatacttttaatgagaagaggtttacttatagttcactttttgcatgaaactaatgctgcatgaaaatactttatttgcatgaatttggggataaattatattgtaatatataatttttaattgacaagattaattaaggctaactttatggttaaacatgactttcagcatggaggttaggcaactatatacatgaaactcctatcttcctgcctaaaactgtcaacatattcttttgtttatagagaatgtggtcttttgcaaaatgaaaagatgaaaactttattctcaaacatgacagagcgttccttttatcaatggcaaatcgagggaaacataccaatggttcccagtttttcattaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361807 - DNA, 6746 bp, Homo sapiens
ggtttttttttttaagtgttttgttttgttgttttggagttgagagtaactttaatttttatgtgtattcatgctgtgtatttatggctacaagtcaaactgatttcatatgtatgcatacatatagtctaatagagatgattgtaattcattataatcttgagttttttaaattagtaagatggctactattgctgttttggggtttttaaggttagatatatatcatgtttaactttttcccctatctttttatctttacttctttgttctctacatgctgtgtttaaacctttctgctctcttcacctgaacacatcgtgtttgacatcatctttgtgttgatgtttattacatagtaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaatacagatgtgggttggggtcccctggagcaggcaggattggcagtaagagatattggccactcaagtctactgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361808 - DNA, 7393 bp, Homo sapiens
gtactctcgcggtatttgtcccgactctcgcggggtttagcgtggcattgggaggcccggcctgggggaggagacggcgttccgttagcggcgttggggtttggctgcagtggcagtgctttctcttctgctcacggggacccgctcaggctggaggccagccagctcttgccgccacctcggtcgcgatgggggcgcaggaccggccgcagtgccacttcgacatcgagatcaaccgggagccggttggtcgcattatgtttcagctcttctcagacatatgtccaaaaacatgcaaaaacttcctttgcttgtgctcaggagagaaaggccttgggaaaacaactgggaagaagttatgttataaaggttctacgttccatcgtgtggttaaaaactttatgattcagggtggggacttcagtgaaggtaatggaaaaggtggagaatcaatttatggtggatattttaaagagaatgtggtcttttgcaaaatgaaaagatgaaaactttattctcaaacatgacagagcgttccttttatcaatggcaaatcgagggaaacataccaatggttcccagtttttcataaagagtgttacaccgtgcgctccaaagtaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361809 - DNA, 7153 bp, Homo sapiens
gtcaatctgtgctcatggatgggcttctcagcaatataattctttttattttttatttttctcttcagttttccaaaatgggtcggatagtaagcagtacaatatcatgtgtccctgtaaggaaggttcccaagtaccaagcgaaatctgaatgttaccagactctttaccctaaaatggttaagaaccattgttttaaaggcagaaaactgaggcccagtttgcataatcgtttccttttatgaagcagatttcaagttctcattccattctagttgcttcatacaacaaacagtttggttttattttcaggtctgtggacatgtcattgattacagttaattgtcttgattactgtttatagcttaattatcaaaccagttgtttcttgaatttgtattatgacagggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361810 - DNA, 7080 bp, Homo sapiens
ggtttttttttttaagtgttttgttttgttgttttggagttgagagtaactttaatttttatgtgtattcatgctgtgtatttatggctacaagtcaaactgatttcatatgtatgcatacatatagtctaatagagatgattgtaattcattataatcttgagttttttaaattagtaagatggctactattgctgttttggggtttttaaggttagatatatatcatgtttaactttttcccctatctttttatctttacttctttgttctctacatgctgtgtttaaacctttctgctctcttcacctgaacacatcgtgtttgacatcatctttgtgttgatgtttattacatagtaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361811 - DNA, 5145 bp, Homo sapiens
tgttacccttgggacccggagggccgccggggccctggggtcccgaggggcctcgggcacccggggaagtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361812 - DNA, 4930 bp, Homo sapiens
tctctctctctctctctctctctctctctctctctctctctctctctctctctctctctctctctctctctctctctctctcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361813 - DNA, 2178 bp, Homo sapiens
gtactctcgcggtatttgtcccgactctcgcggggtttagcgtggcattgggaggcccggcctgggggaggagacggcgttccgttagcggcgttggggtttggctgcagtggcagtgctttctcttctgctcacggggacccgctcaggctggaggccagccagctcttgccgccacctcggtcgcgatgggggcgcaggaccggccgcagtgccacttcgacatcgagatcaaccgggagccggttggtcgcattatgtttcagctcttctcagacatatgtccaaaaacatgcaaaaacttcctttgcttgtgctcaggagagaaaggccttgggaaaacaactgggaagaagttatgttataaaggttctacgttccatcgtgtggttaaaaactttatgattcagggtggggacttcagtgaaggtaatggaaaaggtggagaatcaatttatggtggatattttaaaggtaaggcttaatattttacggtcttttgtttcagttctgatattaaagcaagtttgatcatatacttttaatgagaagaggtttacttatagttcactttttgcatgaaactaatgctgcatgaaaatactttatttgcatgaatttggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 361814 - DNA, 5714 bp, Homo sapiens
  misc_feature (5712)..(5712): n is a, c, g, or t
ggtttttttttttaagtgttttgttttgttgttttggagttgagagtaactttaatttttatgtgtattcatgctgtgtatttatggctacaagtcaaactgatttcatatgtatgcatacatatagtctaatagagatgattgtaattcattataatcttgagttttttaaattagtaagatggctactattgctgttttggggtttttaaggttagatatatatcatgtttaactttttcccctatctttttatctttacttctttgttctctacatgctgtgtttaaacctttctgctctcttcacctgaacacatcgtgtttgacatcatctttgtgttgatgtttattacatagtaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtaaaataaagataaacccttnta

SEQ ID NO: 361815 - DNA, 5723 bp, Homo sapiens
ggtttttttttttaagtgttttgttttgttgttttggagttgagagtaactttaatttttatgtgtattcatgctgtgtatttatggctacaagtcaaactgatttcatatgtatgcatacatatagtctaatagagatgattgtaattcattataatcttgagttttttaaattagtaagatggctactattgctgttttggggtttttaaggttagatatatatcatgtttaactttttcccctatctttttatctttacttctttgttctctacatgctgtgtttaaacctttctgctctcttcacctgaacacatcgtgtttgacatcatctttgtgttgatgtttattacatagtaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgtgagcgagtgtaagaacatgaccttgtactgtgaacatgttacctaggagtacttagtcaccttagtgtcacgttaatccagatatgctgaccaaattgatatagtatgcctgccgttcagctcatgactgcactacgagaggacttggatgctgtatgtgggatgtgcacaagagccctcaggttgaggaacgttgacaacaacttgctggaggcaagtgagcccctgtattgagtggctactatcacttaaagaacgccttgaaaacagggtaatgtggttcacttgtatgctggcaagtaatccaacgggtcttgtttaactatgactatagctcgactaaccattcttgcatatggaagc

SEQ ID NO: 361816 - DNA, 5604 bp, Homo sapiens
ggtttttttttttaagtgttttgttttgttgttttggagttgagagtaactttaatttttatgtgtattcatgctgtgtatttatggctacaagtcaaactgatttcatatgtatgcatacatatagtctaatagagatgattgtaattcattataatcttgagttttttaaattagtaagatggctactattgctgttttggggtttttaaggttagatatatatcatgtttaactttttcccctatctttttatctttacttctttgttctctacatgctgtgtttaaacctttctgctctcttcacctgaacacatcgtgtttgacatcatctttgtgttgatgtttattacatagtaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttttgaaaggggtgatgttttaaactattacccacagaaggttgaaacacggtaaggcgtcaagtttttgccggtaatataccatag

SEQ ID NO: 361817 - DNA, 5222 bp, Homo sapiens
ggtttttttttttaagtgttttgttttgttgttttggagttgagagtaactttaatttttatgtgtattcatgctgtgtatttatggctacaagtcaaactgatttcatatgtatgcatacatatagtctaatagagatgattgtaattcattataatcttgagttttttaaattagtaagatggctactattgctgttttggggtttttaaggttagatatatatcatgtttaactttttcccctatctttttatctttacttctttgttctctacatgctgtgtttaaacctttctgctctcttcacctgaacacatcgtgtttgacatcatctttgtgttgatgtttattacatagtaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaa

SEQ ID NO: 361818 - DNA, 440 bp, Homo sapiens
gtactctcgcggtatttgtcccgactctcgcggggtttagcgtggcattgggaggcccggcctgggggaggagacggcgttccgttagcggcgttggggtttggctgcagtggcagtgctttctcttctgctcacggggacccgctcaggctggaggccagccagctcttgccgccacctcggtcgcgatgggggcgcaggaccggccgcagtgccacttcgacatcgagatcaaccgggagccggttggtcgcattatgtttcagctcttctcagacatatgtccaaaaacatgcaaaaacttcctttgcttgtgctcaggtaagtgaattattatttccaatgagaagctgtggcttacagttttaccttgctgaacagaatagatattttcctggaagaataatggactcgtgaaattagttttgtgaattaaaaaa

SEQ ID NO: 361819 - DNA, 736 bp, Homo sapiens
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgaggagattaccccaccccattcctgctgtcgcatcttacccagtagagaccctccttttgagctgtaccccgtctgcattctccacccactcacctgcgcctatccgggctttgactccttattccaggagtaggtgggagtttaagtcacttagtcgggccgacccgccctcgttagtctagaaccctccctttaacgctagagcacagaccccacgcctccctgctgctggcttcttagatccacccccatcataacggccttgctttgccccaagttttaccctgaaacattcctgagagccggaatctggggatttggaatgaaggcatgctttttta

SEQ ID NO: 361820 - DNA, 2499 bp, Homo sapiens
  misc_feature (1845)..(1845): n is a, c, g, or t
  misc_feature (1864)..(1864): n is a, c, g, or t
  misc_feature (1867)..(1867): n is a, c, g, or t
  misc_feature (1871)..(1871): n is a, c, g, or t
  misc_feature (1874)..(1874): n is a, c, g, or t
  misc_feature (1876)..(1876): n is a, c, g, or t
  misc_feature (1882)..(1882): n is a, c, g, or t
  misc_feature (1981)..(1981): n is a, c, g, or t
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaaanaaaaaaaaaaaaaaaaaanaanaaanaananaaaaanaaaaaaaaaaaaaaaaaaaaaaaaacaaaagtaaacaaaagaaaaaagaaaaaaggagagaggaggagcggcgccgaccgacaacaaataaccaaattncaccagcgaggagaagcaagacagtaagacgacgctgcgcaggctcgacgtgccttggagacgagggggaggcgccggcgcgacgagcgacgagtgcgtccacaaacccagtagacgagagcgaggcgcagacgagcaccgacatatcacacgaagagtcggctggggggagaagcaatgataacagtctaacgcagagatctaattgtgggttctcgtctgatgaattacggggacgacacccgtataaaagagtagcgggccgtgggagttcacaatctgttctgtgagaaggacaagaacaagccaatacaaaacataaaggacgacgtcgatgtatagatcctattacgttacgatcgagtataaagaaattaagttagctgtctagtgcagatacgtctgttgaggtggagtgagccgaaaaaagaactgcaggtgtacgattagttgtcgcagaggaggtaagtgacaactcatgcggtcttctaacgtgtcggatgcatcgtgcgagccaa

SEQ ID NO: 361821 - DNA, 2287 bp, Homo sapiens
  misc_feature (1743)..(1743): n is a, c, g, or t
  misc_feature (1762)..(1762): n is a, c, g, or t
  misc_feature (1765)..(1765): n is a, c, g, or t
  misc_feature (1769)..(1769): n is a, c, g, or t
  misc_feature (1772)..(1772): n is a, c, g, or t
  misc_feature (1774)..(1774): n is a, c, g, or t
  misc_feature (1780)..(1780): n is a, c, g, or t
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaaanaaaaaaaaaaaaaaaaaanaanaaanaananaaaaanaaaaaaaaagagggggggggccgggaaaaaagaaatatcccccggggggcccaccccccgcaacacggccccgcccccgtccttcttgtgagcacaaggggggccccaattagggagggggaataaaaaaggacgggaggcagggggggggggttaacaccaggggtgggcgggggagaacaccgggcccgcggggaacccttgggggagggccccccattcttcgcggcgggcggcgaccactctgtcgcggcccaaccccccacggagtgtttaaagccgtctccggggacaattaaacccttcaacgcggtaatgtgggggcaacccccggcaatatgtccgcgggcgaagagttcgctccgggttgtttataggactacgagaggatatatatatatataagacgcaaccacgacgccaccacgccgctataatactgcgatccctccactgccgcgtctgataccctccacactccgacacccaaactacaccatgcgcgcg

SEQ ID NO: 361822 - DNA, 1815 bp, Homo sapiens
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaa

SEQ ID NO: 361823 - DNA, 2270 bp, Homo sapiens
  misc_feature (8)..(8): n is a, c, g, or t
  misc_feature (1726)..(1726): n is a, c, g, or t
  misc_feature (1745)..(1745): n is a, c, g, or t
  misc_feature (1748)..(1748): n is a, c, g, or t
  misc_feature (1752)..(1752): n is a, c, g, or t
  misc_feature (1755)..(1755): n is a, c, g, or t
  misc_feature (1757)..(1757): n is a, c, g, or t
  misc_feature (1763)..(1763): n is a, c, g, or t
ttggtgcnttagtctgttgtcattggtggtggtacggtcggtattccgggatccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaaanaaaaaaaaaaaaaaaaaanaanaaanaananaaaaanaaaaaaaaagagggggggggccgggaaaaaagaaatatcccccggggggcccaccccccgcaacacggccccgcccccgtccttcttgtgagcacaaggggggccccaattagggagggggaataaaaaaggacgggaggcagggggggggggttaacaccaggggtgggcgggggagaacaccgggcccgcggggaacccttgggggagggccccccattcttcgcggcgggcggcgaccactctgtcgcggcccaaccccccacggagtgtttaaagccgtctccggggacaattaaacccttcaacgcggtaatgtgggggcaacccccggcaatatgtccgcgggcgaagagttcgctccgggttgtttataggactacgagaggatatatatatatataagacgcaaccacgacgccaccacgccgctataatactgcgatccctccactgccgcgtctgataccctccacactccgacacccaaactacaccatgcgcgcg

SEQ ID NO: 361824 - DNA, 2312 bp, Homo sapiens
  misc_feature (1768)..(1768): n is a, c, g, or t
  misc_feature (1787)..(1787): n is a, c, g, or t
  misc_feature (1790)..(1790): n is a, c, g, or t
  misc_feature (1794)..(1794): n is a, c, g, or t
  misc_feature (1797)..(1797): n is a, c, g, or t
  misc_feature (1799)..(1799): n is a, c, g, or t
  misc_feature (1805)..(1805): n is a, c, g, or t
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaaanaaaaaaaaaaaaaaaaaanaanaaanaananaaaaanaaaaaaaaagagggggggggccgggaaaaaagaaatatcccccggggggcccaccccccgcaacacggccccgcccccgtccttcttgtgagcacaaggggggccccaattagggagggggaataaaaaaggacgggaggcagggggggggggttaacaccaggggtgggcgggggagaacaccgggcccgcggggaacccttgggggagggccccccattcttcgcggcgggcggcgaccactctgtcgcggcccaaccccccacggagtgtttaaagccgtctccggggacaattaaacccttcaacgcggtaatgtgggggcaacccccggcaatatgtccgcgggcgaagagttcgctccgggttgtttataggactacgagaggatatatatatatataagacgcaaccacgacgccaccacgccgctataatactgcgatccctccactgccgcgtctgataccctccacactccgacacccaaactacaccatgcgcgcg

SEQ ID NO: 361825 - DNA, 2335 bp, Homo sapiens
  misc_feature (1791)..(1791): n is a, c, g, or t
  misc_feature (1810)..(1810): n is a, c, g, or t
  misc_feature (1813)..(1813): n is a, c, g, or t
  misc_feature (1817)..(1817): n is a, c, g, or t
  misc_feature (1820)..(1820): n is a, c, g, or t
  misc_feature (1822)..(1822): n is a, c, g, or t
  misc_feature (1828)..(1828): n is a, c, g, or t
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaaagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaaanaaaaaaaaaaaaaaaaaanaanaaanaananaaaaanaaaaaaaaagagggggggggccgggaaaaaagaaatatcccccggggggcccaccccccgcaacacggccccgcccccgtccttcttgtgagcacaaggggggccccaattagggagggggaataaaaaaggacgggaggcagggggggggggttaacaccaggggtgggcgggggagaacaccgggcccgcggggaacccttgggggagggccccccattcttcgcggcgggcggcgaccactctgtcgcggcccaaccccccacggagtgtttaaagccgtctccggggacaattaaacccttcaacgcggtaatgtgggggcaacccccggcaatatgtccgcgggcgaagagttcgctccgggttgtttataggactacgagaggatatatatatatataagacgcaaccacgacgccaccacgccgctataatactgcgatccctccactgccgcgtctgataccctccacactccgacacccaaactacaccatgcgcgcg

SEQ ID NO: 361826 - DNA, 2271 bp, Homo sapiens
  misc_feature (1727)..(1727): n is a, c, g, or t
  misc_feature (1746)..(1746): n is a, c, g, or t
  misc_feature (1749)..(1749): n is a, c, g, or t
  misc_feature (1753)..(1753): n is a, c, g, or t
  misc_feature (1756)..(1756): n is a, c, g, or t
  misc_feature (1758)..(1758): n is a, c, g, or t
  misc_feature (1764)..(1764): n is a, c, g, or t
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaaanaaaaaaaaaaaaaaaaaanaanaaanaananaaaaanaaaaaaaaagagggggggggccgggaaaaaagaaatatcccccggggggcccaccccccgcaacacggccccgcccccgtccttcttgtgagcacaaggggggccccaattagggagggggaataaaaaaggacgggaggcagggggggggggttaacaccaggggtgggcgggggagaacaccgggcccgcggggaacccttgggggagggccccccattcttcgcggcgggcggcgaccactctgtcgcggcccaaccccccacggagtgtttaaagccgtctccggggacaattaaacccttcaacgcggtaatgtgggggcaacccccggcaatatgtccgcgggcgaagagttcgctccgggttgtttataggactacgagaggatatatatatatataagacgcaaccacgacgccaccacgccgctataatactgcgatccctccactgccgcgtctgataccctccacactccgacacccaaactacaccatgcgcgcg

SEQ ID NO: 361827 - DNA, 2233 bp, Homo sapiens
  misc_feature (1689)..(1689): n is a, c, g, or t
  misc_feature (1708)..(1708): n is a, c, g, or t
  misc_feature (1711)..(1711): n is a, c, g, or t
  misc_feature (1715)..(1715): n is a, c, g, or t
  misc_feature (1718)..(1718): n is a, c, g, or t
  misc_feature (1720)..(1720): n is a, c, g, or t
  misc_feature (1726)..(1726): n is a, c, g, or t
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggacttgaaagaggagattgatattcgactctccagggttcaggatatcaagtatgagccccagctccttgcagatgatgatgctagactactacaactggaaacccagggaaatcaaaagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaaanaaaaaaaaaaaaaaaaaanaanaaanaananaaaaanaaaaaaaaagagggggggggccgggaaaaaagaaatatcccccggggggcccaccccccgcaacacggccccgcccccgtccttcttgtgagcacaaggggggccccaattagggagggggaataaaaaaggacgggaggcagggggggggggttaacaccaggggtgggcgggggagaacaccgggcccgcggggaacccttgggggagggccccccattcttcgcggcgggcggcgaccactctgtcgcggcccaaccccccacggagtgtttaaagccgtctccggggacaattaaacccttcaacgcggtaatgtgggggcaacccccggcaatatgtccgcgggcgaagagttcgctccgggttgtttataggactacgagaggatatatatatatataagacgcaaccacgacgccaccacgccgctataatactgcgatccctccactgccgcgtctgataccctccacactccgacacccaaactacaccatgcgcgcg

SEQ ID NO: 361828 - DNA, 2169 bp, Homo sapiens
  misc_feature (1625)..(1625): n is a, c, g, or t
  misc_feature (1644)..(1644): n is a, c, g, or t
  misc_feature (1647)..(1647): n is a, c, g, or t
  misc_feature (1651)..(1651): n is a, c, g, or t
  misc_feature (1654)..(1654): n is a, c, g, or t
  misc_feature (1656)..(1656): n is a, c, g, or t
  misc_feature (1662)..(1662): n is a, c, g, or t
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaaanaaaaaaaaaaaaaaaaaanaanaaanaananaaaaanaaaaaaaaagagggggggggccgggaaaaaagaaatatcccccggggggcccaccccccgcaacacggccccgcccccgtccttcttgtgagcacaaggggggccccaattagggagggggaataaaaaaggacgggaggcagggggggggggttaacaccaggggtgggcgggggagaacaccgggcccgcggggaacccttgggggagggccccccattcttcgcggcgggcggcgaccactctgtcgcggcccaaccccccacggagtgtttaaagccgtctccggggacaattaaacccttcaacgcggtaatgtgggggcaacccccggcaatatgtccgcgggcgaagagttcgctccgggttgtttataggactacgagaggatatatatatatataagacgcaaccacgacgccaccacgccgctataatactgcgatccctccactgccgcgtctgataccctccacactccgacacccaaactacaccatgcgcgcg

SEQ ID NO: 361829 - DNA, 2156 bp, Homo sapiens
  misc_feature (1612)..(1612): n is a, c, g, or t
  misc_feature (1631)..(1631): n is a, c, g, or t
  misc_feature (1634)..(1634): n is a, c, g, or t
  misc_feature (1638)..(1638): n is a, c, g, or t
  misc_feature (1641)..(1641): n is a, c, g, or t
  misc_feature (1643)..(1643): n is a, c, g, or t
  misc_feature (1649)..(1649): n is a, c, g, or t
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggacttgaaagaggagattgatattcgactctccagggttcaggatatcaagtatgagccccagctccttgcagatgatgatgctagactactacaactggaaacccagggaaatcaaaagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaaanaaaaaaaaaaaaaaaaaanaanaaanaananaaaaanaaaaaaaaagagggggggggccgggaaaaaagaaatatcccccggggggcccaccccccgcaacacggccccgcccccgtccttcttgtgagcacaaggggggccccaattagggagggggaataaaaaaggacgggaggcagggggggggggttaacaccaggggtgggcgggggagaacaccgggcccgcggggaacccttgggggagggccccccattcttcgcggcgggcggcgaccactctgtcgcggcccaaccccccacggagtgtttaaagccgtctccggggacaattaaacccttcaacgcggtaatgtgggggcaacccccggcaatatgtccgcgggcgaagagttcgctccgggttgtttataggactacgagaggatatatatatatataagacgcaaccacgacgccaccacgccgctataatactgcgatccctccactgccgcgtctgataccctccacactccgacacccaaactacaccatgcgcgcg

SEQ ID NO: 361830 - DNA, 1659 bp, Homo sapiens
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggacttgaaagaggagattgatattcgactctccagggttcaggatatcaagtatgagccccagctccttgcagatgatgatgctagactactacaactggaaacccagggaaatcaaaagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaa

SEQ ID NO: 361831 - DNA, 2260 bp, Homo sapiens
  misc_feature (1716)..(1716): n is a, c, g, or t
  misc_feature (1735)..(1735): n is a, c, g, or t
  misc_feature (1738)..(1738): n is a, c, g, or t
  misc_feature (1742)..(1742): n is a, c, g, or t
  misc_feature (1745)..(1745): n is a, c, g, or t
  misc_feature (1747)..(1747): n is a, c, g, or t
  misc_feature (1753)..(1753): n is a, c, g, or t
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctactatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaaanaaaaaaaaaaaaaaaaaanaanaaanaananaaaaanaaaaaaaaagagggggggggccgggaaaaaagaaatatcccccggggggcccaccccccgcaacacggccccgcccccgtccttcttgtgagcacaaggggggccccaattagggagggggaataaaaaaggacgggaggcagggggggggggttaacaccaggggtgggcgggggagaacaccgggcccgcggggaacccttgggggagggccccccattcttcgcggcgggcggcgaccactctgtcgcggcccaaccccccacggagtgtttaaagccgtctccggggacaattaaacccttcaacgcggtaatgtgggggcaacccccggcaatatgtccgcgggcgaagagttcgctccgggttgtttataggactacgagaggatatatatatatataagacgcaaccacgacgccaccacgccgctataatactgcgatccctccactgccgcgtctgataccctccacactccgacacccaaactacaccatgcgcgcg

SEQ ID NO: 361832 - DNA, 1535 bp, Homo sapiens
  misc_feature (991)..(991): n is a, c, g, or t
  misc_feature (1010)..(1010): n is a, c, g, or t
  misc_feature (1013)..(1013): n is a, c, g, or t
  misc_feature (1017)..(1017): n is a, c, g, or t
  misc_feature (1020)..(1020): n is a, c, g, or t
  misc_feature (1022)..(1022): n is a, c, g, or t
  misc_feature (1028)..(1028): n is a, c, g, or t
tggtttctctgctgctagttgtttttggtatgagtagggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaaanaaaaaaaaaaaaaaaaaanaanaaanaananaaaaanaaaaaaaaagagggggggggccgggaaaaaagaaatatcccccggggggcccaccccccgcaacacggccccgcccccgtccttcttgtgagcacaaggggggccccaattagggagggggaataaaaaaggacgggaggcagggggggggggttaacaccaggggtgggcgggggagaacaccgggcccgcggggaacccttgggggagggccccccattcttcgcggcgggcggcgaccactctgtcgcggcccaaccccccacggagtgtttaaagccgtctccggggacaattaaacccttcaacgcggtaatgtgggggcaacccccggcaatatgtccgcgggcgaagagttcgctccgggttgtttataggactacgagaggatatatatatatataagacgcaaccacgacgccaccacgccgctataatactgcgatccctccactgccgcgtctgataccctccacactccgacacccaaactacaccatgcgcgcg

SEQ ID NO: 361833 - DNA, 1519 bp, Homo sapiens
  misc_feature (975)..(975): n is a, c, g, or t
  misc_feature (994)..(994): n is a, c, g, or t
  misc_feature (997)..(997): n is a, c, g, or t
  misc_feature (1001)..(1001): n is a, c, g, or t
  misc_feature (1004)..(1004): n is a, c, g, or t
  misc_feature (1006)..(1006): n is a, c, g, or t
  misc_feature (1012)..(1012): n is a, c, g, or t
tgatatacctgactcttgaggaaaaacgacgcccagtgaaagctttcagatagcatcaagatcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaaanaaaaaaaaaaaaaaaaaanaanaaanaananaaaaanaaaaaaaaagagggggggggccgggaaaaaagaaatatcccccggggggcccaccccccgcaacacggccccgcccccgtccttcttgtgagcacaaggggggccccaattagggagggggaataaaaaaggacgggaggcagggggggggggttaacaccaggggtgggcgggggagaacaccgggcccgcggggaacccttgggggagggccccccattcttcgcggcgggcggcgaccactctgtcgcggcccaaccccccacggagtgtttaaagccgtctccggggacaattaaacccttcaacgcggtaatgtgggggcaacccccggcaatatgtccgcgggcgaagagttcgctccgggttgtttataggactacgagaggatatatatatatataagacgcaaccacgacgccaccacgccgctataatactgcgatccctccactgccgcgtctgataccctccacactccgacacccaaactacaccatgcgcgcg

SEQ ID NO: 361834 - DNA, 1228 bp, Homo sapiens
  misc_feature (684)..(684): n is a, c, g, or t
  misc_feature (703)..(703): n is a, c, g, or t
  misc_feature (706)..(706): n is a, c, g, or t
  misc_feature (710)..(710): n is a, c, g, or t
  misc_feature (713)..(713): n is a, c, g, or t
  misc_feature (715)..(715): n is a, c, g, or t
  misc_feature (721)..(721): n is a, c, g, or t
ccaacttgagctcggtacccatccttcctctctcacgcatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaaanaaaaaaaaaaaaaaaaaanaanaaanaananaaaaanaaaaaaaaagagggggggggccgggaaaaaagaaatatcccccggggggcccaccccccgcaacacggccccgcccccgtccttcttgtgagcacaaggggggccccaattagggagggggaataaaaaaggacgggaggcagggggggggggttaacaccaggggtgggcgggggagaacaccgggcccgcggggaacccttgggggagggccccccattcttcgcggcgggcggcgaccactctgtcgcggcccaaccccccacggagtgtttaaagccgtctccggggacaattaaacccttcaacgcggtaatgtgggggcaacccccggcaatatgtccgcgggcgaagagttcgctccgggttgtttataggactacgagaggatatatatatatataagacgcaaccacgacgccaccacgccgctataatactgcgatccctccactgccgcgtctgataccctccacactccgacacccaaactacaccatgcgcgcg

SEQ ID NO: 361835 - DNA, 992 bp, Homo sapiens
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgccgtgagtttggaggggaacgtgtcagagggagctggtacagtagtgttggactgttgccacagtgcagtgaccttcataaagcatataaacaaaatccatg

SEQ ID NO: 361836 - DNA, 1747 bp, Homo sapiens
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgccgtgagtttggaggggaacgtgtcagagggagctggtacagtagtgttggactgttgccacagtgcagtgaccttcataaagcatataaacaaaatccatgataccataagagttgtcaggttctagactattagatcagtctcttacattagaaagcagatgcggccgggcacagtggttcacgcctataatcccagcactttgggaggccgaggcgggaggatcatctgaggttgggaatccgagaccagcctgaccaacatggagaaaccccgttctctactaaaaatacaaaattagccgggcgtggtggcgcatgcctgtaatcctagcttctggggaggctgaggcaggagaatctcttgaacccgggaggcggaggttgcggtgagccaagatcgtgccattatactccagcctgggcaacaaaagtgaaactctgtctcaaaaaaaaaaaagaagaaaagaaagcagatgcaactatacaagctagtaaaagaagtttttactagcatttttcttgtgtgcatttttcttgtcttttgtttagcccaataaaatgtcaaaattggtgtagcctagcaaagggaatagtttttcagcacacacagggattccttctcttcagagtctcagcgtcccttttgtgtcttggcccaataaaagtaagaattaaataacattgggccgggcgcggtggctcacgcctgtaatcccagcactttgggaggccgaggcaggcgaatcatgaggtcaagagatcaagaccatcctagccaacaaggtgaaaccctgtctctactaaaaatacaaaaattagctgggcatggtggtgcgtgcctgtaatctcagcta

SEQ ID NO: 361837 - DNA, 1645 bp, Homo sapiens
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgccgtgagtttggaggggaacgtgtcagagggagctggtacagtagtgttggactgttgccacagtgcagtgaccttcataaagcatataaacaaaatccatgataccataagagttgtcaggttctagactattagatcagtctcttacattagaaagcagatgcggccgggcacagtggttcacgcctataatcccagcactttgggaggccgaggcgggaggatcatctgaggttgggaatccgagaccagcctgaccaacatggagaaaccccgttctctactaaaaatacaaaattagccgggcgtggtggcgcatgcctgtaatcctagcttctggggaggctgaggcaggagaatctcttgaacccgggaggcggaggttgcggtgagccaagatcgtgccattatactccagcctgggcaacaaaagtgaaactctgtctcaaaaaaaaaaaagaagaaaagaaagcagatgcaactatacaagctagtaaaagaagtttttactagcatttttcttgtgtgcatttttcttgtcttttgtttagcccaataaaatgtcaaaattggtgtagcctagcaaagggaatagtttttcagcacacacagggattccttctcttcagagtctcagcgtcccttttgtgtcttggcccaataaaagtaagaattaaataacattgggccgggcgcggtggctcacgcctgtaatcccagcactttgggaggccgaggcaggcgaatcatgaggtcaagagatcaagaccatcctagccaacaaggtgaaaccctgtctctactaaaaatacaaaaattagctgggcatggtggtgcgtgcctgtaatctcagcta

SEQ ID NO: 361838 - DNA, 1069 bp, Homo sapiens
  misc_feature (984)..(984): n is a, c, g, or t
  misc_feature (988)..(988): n is a, c, g, or t
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaagggcnggantaagcccgcctggcattggcaaaggttgtggcgcggccctcgaaattggccaggccaatggttcaccatccggtccacgta

SEQ ID NO: 361839 - DNA, 1188 bp, Homo sapiens
aagatcactgccactgcactccagcccgggtgacagagcgagactccatctcaaaaaaaaagactaaagaatgagaagagatatcattgtgctgttttctccacagagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgccgtgagtttggaggggaacgtgtcagagggagctggtacagtagtgttggactgttgccacagtgcagtgaccttcataaagcatataaacaaaatccatgataccataagagttgtcaggttctagactattagatcagtctcttacattagaaagcagatgcggccgggcacagtggttcacgcctataatcccagcactttgggaggccgaggcgggaggatcatctgaggttgggaatccgagaccagcctgaccaacatggagaaaccccgttctctactaaaaatacaaaattagccgggcgtggtggcgcatgcctgtaatcctagcttctggggaggctgaggcaggagaatctcttgaacccgggaggcggaggttgcggtgagccaagatcgtgccattatactccagcctgggcaacaaaagtgaaactctgtctcaaaaaaaaaaaagaagaaaagaaagcagatgcaactatacaagctagtaaaagaagtttttactagcatttttcttgtgtgcatttttcttgtcttttgtttagcccaataaaatgtcaaaattggtgtagcctagcaaagggaatagtttttcagcacacacagggattccttctcttcagagtctcagcgtcccttttgtgtcttggcccaataaaagtaagaattaaataacattgggccgggcgcggtggctcacgcctgtaatcccagcactttgggaggccgaggcaggcgaatcatgaggtcaagagatcaagaccatcctagccaacaaggtgaaaccctgtctctactaaaaatacaaaaattagctgggcatggtggtgcgtgcctgtaatctcagcta

SEQ ID NO: 361840 - DNA, 1039 bp, Homo sapiens
  misc_feature (3)..(3): n is a, c, g, or t
  misc_feature (11)..(11): n is a, c, g, or t
tanggctagtncgaggctggtgttgaatcggccgaggccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggggctctgcgtgattagcagtcgtgctgtgcgaccggtgttgcggcctcgaattgccaggccagttcccagccggtcgcgttacgggtggggtccccccttgttgattggaattcccgtggtgggggggtggagaatggaccccccttggagtcttgggggggggggggcgcttgct

SEQ ID NO: 361841 - DNA, 2389 bp, Homo sapiens
  misc_feature (1845)..(1845): n is a, c, g, or t
  misc_feature (1864)..(1864): n is a, c, g, or t
  misc_feature (1867)..(1867): n is a, c, g, or t
  misc_feature (1871)..(1871): n is a, c, g, or t
  misc_feature (1874)..(1874): n is a, c, g, or t
  misc_feature (1876)..(1876): n is a, c, g, or t
  misc_feature (1882)..(1882): n is a, c, g, or t
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaaanaaaaaaaaaaaaaaaaaanaanaaanaananaaaaanaaaaaaaaagagggggggggccgggaaaaaagaaatatcccccggggggcccaccccccgcaacacggccccgcccccgtccttcttgtgagcacaaggggggccccaattagggagggggaataaaaaaggacgggaggcagggggggggggttaacaccaggggtgggcgggggagaacaccgggcccgcggggaacccttgggggagggccccccattcttcgcggcgggcggcgaccactctgtcgcggcccaaccccccacggagtgtttaaagccgtctccggggacaattaaacccttcaacgcggtaatgtgggggcaacccccggcaatatgtccgcgggcgaagagttcgctccgggttgtttataggactacgagaggatatatatatatataagacgcaaccacgacgccaccacgccgctataatactgcgatccctccactgccgcgtctgataccctccacactccgacacccaaactacaccatgcgcgcg

SEQ ID NO: 361842 - DNA, 2504 bp, Homo sapiens
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaaaaaccaacaacaaagagaggcgcgcgggcgcgcctcagagagagtttctccccgtgcgagagcggcgcccccaagagcttctctgcgcgcgccgtttccccccgaagtgactatgtccacgtggctcataaccaaatgcgggtgggttctgccccaattagatgagaggcgagacgacctgcaggcctcacctcatcactattagacggccccctgagggcgcacacagacgctgcgcccagcggctgcgcaggtctttattcaataccacaagacgaagttccagcggggctcgcaccacgcggggggcgtacaacaaacaaccggccgtggtgcacagccaaccgccacatgttgaggcagcactaaccctcttgatgccgaggctgatcgacagcagagccgacaaacacccccttctaaagcccctacctcctcgcctgtgcagacggcgaccgtggcggacgcacacccacactattcaatcctccggtcggggcggcaccacaaacaacgaaccactaaactctgcatactaacacaaacagacgacagactactttctctcacagcagcgcgcacctcactcatatctgcgcgcgcatcaccacatcccatgatagcacaagacgctacctcccacaacagcacggccagacgagcacaccatactaaacgagcggctggct

SEQ ID NO: 361843 - DNA, 2455 bp, Homo sapiens
  misc_feature (1801)..(1801): n is a, c, g, or t
  misc_feature (1820)..(1820): n is a, c, g, or t
  misc_feature (1823)..(1823): n is a, c, g, or t
  misc_feature (1827)..(1827): n is a, c, g, or t
  misc_feature (1830)..(1830): n is a, c, g, or t
  misc_feature (1832)..(1832): n is a, c, g, or t
  misc_feature (1838)..(1838): n is a, c, g, or t
  misc_feature (1937)..(1937): n is a, c, g, or t
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatggagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaaanaaaaaaaaaaaaaaaaaanaanaaanaananaaaaanaaaaaaaaaaaaaaaaaaaaaaaaacaaaagtaaacaaaagaaaaaagaaaaaaggagagaggaggagcggcgccgaccgacaacaaataaccaaattncaccagcgaggagaagcaagacagtaagacgacgctgcgcaggctcgacgtgccttggagacgagggggaggcgccggcgcgacgagcgacgagtgcgtccacaaacccagtagacgagagcgaggcgcagacgagcaccgacatatcacacgaagagtcggctggggggagaagcaatgataacagtctaacgcagagatctaattgtgggttctcgtctgatgaattacggggacgacacccgtataaaagagtagcgggccgtgggagttcacaatctgttctgtgagaaggacaagaacaagccaatacaaaacataaaggacgacgtcgatgtatagatcctattacgttacgatcgagtataaagaaattaagttagctgtctagtgcagatacgtctgttgaggtggagtgagccgaaaaaagaactgcaggtgtacgattagttgtcgcagaggaggtaagtgacaactcatgcggtcttctaacgtgtcggatgcatcgtgcgagccaa

SEQ ID NO: 361844 - DNA, 2210 bp, Homo sapiens
  misc_feature (1666)..(1666): n is a, c, g, or t
  misc_feature (1685)..(1685): n is a, c, g, or t
  misc_feature (1688)..(1688): n is a, c, g, or t
  misc_feature (1692)..(1692): n is a, c, g, or t
  misc_feature (1695)..(1695): n is a, c, g, or t
  misc_feature (1697)..(1697): n is a, c, g, or t
  misc_feature (1703)..(1703): n is a, c, g, or t
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaaanaaaaaaaaaaaaaaaaaanaanaaanaananaaaaanaaaaaaaaagagggggggggccgggaaaaaagaaatatcccccggggggcccaccccccgcaacacggccccgcccccgtccttcttgtgagcacaaggggggccccaattagggagggggaataaaaaaggacgggaggcagggggggggggttaacaccaggggtgggcgggggagaacaccgggcccgcggggaacccttgggggagggccccccattcttcgcggcgggcggcgaccactctgtcgcggcccaaccccccacggagtgtttaaagccgtctccggggacaattaaacccttcaacgcggtaatgtgggggcaacccccggcaatatgtccgcgggcgaagagttcgctccgggttgtttataggactacgagaggatatatatatatataagacgcaaccacgacgccaccacgccgctataatactgcgatccctccactgccgcgtctgataccctccacactccgacacccaaactacaccatgcgcgcg

SEQ ID NO: 361845 - DNA, 1586 bp, Homo sapiens
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaa

SEQ ID NO: 361846 - DNA, 2137 bp, Homo sapiens
  misc_feature (3)..(3): n is a, c, g, or t
  misc_feature (11)..(11): n is a, c, g, or t
  misc_feature (1593)..(1593): n is a, c, g, or t
  misc_feature (1612)..(1612): n is a, c, g, or t
  misc_feature (1615)..(1615): n is a, c, g, or t
  misc_feature (1619)..(1619): n is a, c, g, or t
  misc_feature (1622)..(1622): n is a, c, g, or t
  misc_feature (1624)..(1624): n is a, c, g, or t
  misc_feature (1630)..(1630): n is a, c, g, or t
tanggctagtncgaggctggtgttgaatcggccgaggccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaaanaaaaaaaaaaaaaaaaaanaanaaanaananaaaaanaaaaaaaaagagggggggggccgggaaaaaagaaatatcccccggggggcccaccccccgcaacacggccccgcccccgtccttcttgtgagcacaaggggggccccaattagggagggggaataaaaaaggacgggaggcagggggggggggttaacaccaggggtgggcgggggagaacaccgggcccgcggggaacccttgggggagggccccccattcttcgcggcgggcggcgaccactctgtcgcggcccaaccccccacggagtgtttaaagccgtctccggggacaattaaacccttcaacgcggtaatgtgggggcaacccccggcaatatgtccgcgggcgaagagttcgctccgggttgtttataggactacgagaggatatatatatatataagacgcaaccacgacgccaccacgccgctataatactgcgatccctccactgccgcgtctgataccctccacactccgacacccaaactacaccatgcgcgcg

SEQ ID NO: 361847 - DNA, 1830 bp, Homo sapiens
  misc_feature (1286)..(1286): n is a, c, g, or t
  misc_feature (1305)..(1305): n is a, c, g, or t
  misc_feature (1308)..(1308): n is a, c, g, or t
  misc_feature (1312)..(1312): n is a, c, g, or t
  misc_feature (1315)..(1315): n is a, c, g, or t
  misc_feature (1317)..(1317): n is a, c, g, or t
  misc_feature (1323)..(1323): n is a, c, g, or t
aagatcactgccactgcactccagcccgggtgacagagcgagactccatctcaaaaaaaaagactaaagaatgagaagagatatcattgtgctgttttctccacagagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaaanaaaaaaaaaaaaaaaaaanaanaaanaananaaaaanaaaaaaaaagagggggggggccgggaaaaaagaaatatcccccggggggcccaccccccgcaacacggccccgcccccgtccttcttgtgagcacaaggggggccccaattagggagggggaataaaaaaggacgggaggcagggggggggggttaacaccaggggtgggcgggggagaacaccgggcccgcggggaacccttgggggagggccccccattcttcgcggcgggcggcgaccactctgtcgcggcccaaccccccacggagtgtttaaagccgtctccggggacaattaaacccttcaacgcggtaatgtgggggcaacccccggcaatatgtccgcgggcgaagagttcgctccgggttgtttataggactacgagaggatatatatatatataagacgcaaccacgacgccaccacgccgctataatactgcgatccctccactgccgcgtctgataccctccacactccgacacccaaactacaccatgcgcgcg

SEQ ID NO: 361848 - DNA, 2270 bp, Homo sapiens
  misc_feature (1726)..(1726): n is a, c, g, or t
  misc_feature (1745)..(1745): n is a, c, g, or t
  misc_feature (1748)..(1748): n is a, c, g, or t
  misc_feature (1752)..(1752): n is a, c, g, or t
  misc_feature (1755)..(1755): n is a, c, g, or t
  misc_feature (1757)..(1757): n is a, c, g, or t
  misc_feature (1763)..(1763): n is a, c, g, or t
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtaaaaaaaaaaanaaaaaaaaaaaaaaaaaanaanaaanaananaaaaanaaaaaaaaagagggggggggccgggaaaaaagaaatatcccccggggggcccaccccccgcaacacggccccgcccccgtccttcttgtgagcacaaggggggccccaattagggagggggaataaaaaaggacgggaggcagggggggggggttaacaccaggggtgggcgggggagaacaccgggcccgcggggaacccttgggggagggccccccattcttcgcggcgggcggcgaccactctgtcgcggcccaaccccccacggagtgtttaaagccgtctccggggacaattaaacccttcaacgcggtaatgtgggggcaacccccggcaatatgtccgcgggcgaagagttcgctccgggttgtttataggactacgagaggatatatatatatataagacgcaaccacgacgccaccacgccgctataatactgcgatccctccactgccgcgtctgataccctccacactccgacacccaaactacaccatgcgcgcg

SEQ ID NO: 361849 - DNA, 1054 bp, Homo sapiens
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaacaacttccgggggatactccctcggtcgaaataagggcccggttctgatgggagcttgggacttaacgggggaccgg

SEQ ID NO: 361850 - DNA, 1518 bp, Homo sapiens
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgccgtgagtttggaggggaacgtgtcagagggagctggtacagtagtgttggactgttgccacagtgcagtgaccttcataaagcatataaacaaaatccatgataccataagagttgtcaggttctagactattagatcagtctcttacattagaaagcagatgcggccgggcacagtggttcacgcctataatcccagcactttgggaggccgaggcgggaggatcatctgaggttgggaatccgagaccagcctgaccaacatggagaaaccccgttctctactaaaaatacaaaattagccgggcgtggtggcgcatgcctgtaatcctagcttctggggaggctgaggcaggagaatctcttgaacccgggaggcggaggttgcggtgagccaagatcgtgccattatactccagcctgggcaacaaaagtgaaactctgtctcaaaaaaaaaaaataaaatataaaaagaaaaaaaaaatggggggggttttttgtgggggggggaaacaagaggtttataaaaggggaaggggtataggggttctgggaccatttttttttaaaagggggaaataggggggggccaaaaaggggggggataattgaaaagggggtaacctgt

SEQ ID NO: 361851 - DNA, 1040 bp, Homo sapiens
  misc_feature (931)..(932): n is a, c, g, or t
  misc_feature (939)..(939): n is a, c, g, or t
  misc_feature (941)..(941): n is a, c, g, or t
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaaagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaactccggannctccccngngaaaagaatgcaagcttctgatgaggtaggacctaacctgggtctgggggggaggtgcgaaaacctggtggaagggtgggcccattgtgagagagtcac

SEQ ID NO: 361852 - DNA, 592 bp, Homo sapiens
  misc_feature (510)..(510): n is a, c, g, or t
  misc_feature (582)..(582): n is a, c, g, or t
acggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccagggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggacttgaaagaggagattgatattcgactctccagggttcaggatatcaagtatgagccccagctccttgcagatgatgatgctagactactacaactggaaacccagggaaatcaaanggctacaactaatctgtaataggatggcttctggatggccattcgtacctctggagatccccattctctggncggctccccg

SEQ ID NO: 361853 - DNA, 560 bp, Homo sapiens
agcggaacgtactatcctccttacttttgggtcgggccctccgggaagatggcggccgtgcaggcggccgaggtgaaagtggatggcagcgagccgaaactgagcaagaagtggtggtaatcattagttccagggtgctctgccatgttgacgcaagctgctgtaaggcttgttagggggtccctgcgcaaaacctcctgggcagagtggggtcacagggaactgcgactgggtcaacttgctcctttcacagcgcctcacaaggacaagtcattttctgatcaaagaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataa

SEQ ID NO: 361854 - DNA, 2013 bp, Homo sapiens
agcggaacgtactatcctccttacttttgggtcgggccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataa

SEQ ID NO: 361855 - DNA, 920 bp, Homo sapiens
agcgctgctaccgaagatgccaagatggacgccaggcagccaggagaaagatcccaaccccacccgcgcagatatccgcgaggccccgcgctcagcctcctcacccccgctatccgcggcctccgggtcctcctccgccttccgcttgagcttctgggaggaggggctcaccggcgcgtcccccagcaggtacttatgctcctggccccgcaggtgcttgaggtagcggtccttcagggactgccacgagtgctgcgtgagcgagctcttctccatcgctttccacaaggcgttaccggtgacggagctgggcgagcgggcattttccttcacgtaggtaaggatggctacgtcgtccgcatccgtgaaggcgatccgcccggcgtgccgctgcggctccggctccgcggcgccctcggccagggccccgggctttgcttccgagccggtgtccgccgccgaggcggggcccagccgataggcctccagctccagcctctcgttgcgctccacgcagtccaggatgtactgcgtggagatgaaatcacccgaggcctcggccagcgcctccccgggctgggccagcagcacggccccgggctcctgcactcggcacacggtgccgccgccgtgcaggatgagcgtcgacagccgacgcttggccgggctgggccgcacgtagaaggacatggagctgccgtcgtccctcacgaacagagtcgaggaatgggtgggcccgttggggtctttgcccaaatccatcgcctccgccatgtctgacgccgagcactactagaagagctaccccctcgcgagcgcctggcacacagagctcaactgactgagctgtcaccgcagacgcctctgccgcgaagcgcagcactgggcctgcgcagcagcagccgcggcgcatcgagagt

SEQ ID NO: 361856 - DNA, 728 bp, Homo sapiens
  misc_feature (8)..(8): n is a, c, g, or t
  misc_feature (51)..(51): n is a, c, g, or t
  misc_feature (61)..(61): n is a, c, g, or t
ggaaaccnaagaacttgtgaaacttttgccaaacttgttgatccccccccncggaccacanccaggctccttgacaacttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataaaaaacaaaaaattctccagcgctg

SEQ ID NO: 361857 - DNA, 738 bp, Homo sapiens
  misc_feature (682)..(682): n is a, c, g, or t
agcggaacgtactatcctccttacttttgggtcgggccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatgtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgnaactcccatgatgaacatcatcccggcgggagccaataaagttggtgaaaaaaaaa

SEQ ID NO: 361858 - DNA, 2193 bp, Homo sapiens
agcggaacgtactatcctccttacttttgggtcgggccctccgggaagatggcggccgtgcaggcggccgaggtgaaagtggatggcagcgagccgaaactgagcaagaagtggtggtaatcattagttccagggtgctctgccatgttgacgcaagctgctgtaaggcttgttagggggtccctgcgcaaaacctcctgggcagagtggggtcacagggaactgcgactgggtcaacttgctcctttcacagcgcctcacaaggacaagtcattttctgatcaaagaagtgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataa

SEQ ID NO: 361859 - DNA, 2307 bp, Homo sapiens
agcggaacgtactatcctccttacttttgggtcgggccctccgggaagatggcggccgtgcaggcggccgaggtgaaagtggatggcagcgagccgaaactgagcaagaagtgagtgtcgctgcgagtctttaaagcctttgcggtaggagagtctgggctgggaagcgccgcgaggttcccaccaaggctgctgtgccggggccttcttgccggctctcgtgggtggtggtaatcattagttccagggtgctctgccatgttgacgcaagctgctgtaaggcttgttagggggtccctgcgcaaaacctcctgggcagagtggggtcacagggaactgcgactgggtcaacttgctcctttcacagcgcctcacaaggacaagtcattttctgatcaaagaagtgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataa

SEQ ID NO: 361860 - DNA, 2092 bp, Homo sapiens
agcgctgctaccgaagatgccaagatggacgccaggcagccaggagaaagatcccaaccccacccgcgcagatatccgcgaggccccgcgctcagcctcctcacccccgctatccgcggcctccgggtcctcctccgccttccgcttgagcttctgggaggaggggctcaccggcgcgtcccccagcagtgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataa

SEQ ID NO: 361861 - DNA, 2078 bp, Homo sapiens
aacgtaagtgactcgactcaccatgcaaatgtggtctacaaaagtgacaacaaggccacctgtaccaattaaaaattaaacttttatgattttaggcagaactcaggtttttctttttgttgactcttgcattttgaaatgctggcctctggccgccctgcatattttaagtgcaaatctcactccatattcaatcctgtaatgcagaggtcttggttaaagaaaacaatgtattggggtcactcgggggcagaatactgccctctgctaggtgggccccactggtctgaccaggttcaacttctgaagggcttttttttttttttttttaacagcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataa

SEQ ID NO: 361862 - DNA, 2027 bp, Homo sapiens
agcggaacgtactatcctccttacttttgggtcgggccctccgggaagatggcggccgtgcaggcggccgaggtgaaagtggatggcagcgagccgaaactgagcaagaagtggtggtaatcattagttccagggtgctctgccatgttgacgcaagctgctgtaaggcttgttagggggtccctgcgcaaaacctcctgggcagagtggggtcacagggaactgcgactgggtcaacttgctcctttcacagcgcctcacaaggacaagtcattttctgatcaaagaagtgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatgtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataa

SEQ ID NO: 361863 - DNA, 1666 bp, Homo sapiens
  misc_feature (6)..(6): n is a, c, g, or t
attganaccctagggagcttgtacgacatgaccattactacgccaagcttggcacgaggacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataa

SEQ ID NO: 361864 - DNA, 2374 bp, Homo sapiens
  misc_feature (2037)..(2037): n is a, c, g, or t
agcggaacgtactatcctccttacttttgggtcgggccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataaaaaaaaaaaaaaaaaaaaaaaaanaaaaaaaaaaaggggggggggggaaaaaaaacggggggggcatcttacacccgttttttgttaagagggcgccaagaaggcggtaaaaacgacgggggcgggggtacaaacggtgggggggaaacgtcgttggatcttgggggaacgcttttgggtgggcatttggcacaccacaagattagcgttccggaaaaaactgagtttgcggaactcggctttcgggtggatgtttggtttagtactctctctgaatctagttaggggaggggtagttgatgatagagaacagatatgacggaaaagatgagagtggtcgtagtataatattagcttgata

SEQ ID NO: 361865 - DNA, 2064 bp, Homo sapiens
agcggaacgtactatcctccttacttttgggtcgggccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataaaagccatttgtctcttctctttacttttagaatatcaacttttttccccag

SEQ ID NO: 361866 - DNA, 2037 bp, Homo sapiens
agcggaacgtactatcctccttacttttgggtcgggccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataaaaaacaaaaaattctccagcgctg

SEQ ID NO: 361867 - DNA, 1578 bp, Homo sapiens
agcggaacgtactatcctccttacttttgggtcgggccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgggtaccagctcgattctatcatgt

SEQ ID NO: 361868 - DNA, 1547 bp, Homo sapiens
agcggaacgtactatcctccttacttttgggtcgggccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgcccttccaacttcggggaaaccccaaagcaaagggccccaaagggctcctttgacaagcttgttggggagttcctcggaagtgacttgcattcaattccctttaacaattttccaaatttccttgggtgggaaaattccaaaaccccccccaaaaccaaaggggcacaccttctaacactctggacaaggagcccccc

SEQ ID NO: 361869 - DNA, 704 bp, Homo sapiens
  misc_feature (8)..(8): n is a, c, g, or t
  misc_feature (51)..(51): n is a, c, g, or t
  misc_feature (61)..(61): n is a, c, g, or t
ggaaaccnaagaacttgtgaaacttttgccaaacttgttgatccccccccncggaccacanccaggctccttgacaacttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataa

SEQ ID NO: 361870 - DNA, 904 bp, Homo sapiens
  misc_feature (848)..(848): n is a, c, g, or t
agcggaacgtactatcctccttacttttgggtcgggccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgnaactcccatgatgaacatcatcccggcgggagccaataaagttggtgaaaaaaaaa

SEQ ID NO: 361871 - DNA, 1002 bp, Homo sapiens
agcggaacgtactatcctccttacttttgggtcgggccctccgggaagatggcggccgtgcaggcggccgaggtgaaagtggatggcagcgagccgaaactgagcaagaagtggtggtaatcattagttccagggtgctctgccatgttgacgcaagctgctgtaaggcttgttagggggtccctgcgcaaaacctcctgggcagagtggggtcacagggaactgcgactgggtcaacttgctcctttcacagcgcctcacaaggacaagtcattttctgatcaaagaagtgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggaactctccctggcaaatcactgaactcccacagcaggtaggcctgcggcttcagtagcacaagggaaggtctgggttggtcttgttctcaagtagcctgtgtctgaagctactttactaaggacagtgccattatatctatacagaaagaagcagagcagccctgagacatggaatcatattccagatgaggtagtgctacaaagagaggggctttctctataaggattcccttcatcagcaagaatcagcggtagaagtctcaggcttctaagaattccagtctttggcctaagaatgctttgcactgagacagtatttctagaacattgctcttttggagttgtagtatcttgggtgagatcttcttttcctaaattta

SEQ ID NO: 361872 - DNA, 429 bp, Homo sapiens
cgtcggggagacataattggagttcaggggaatcctggtaaaaccaagaagggtgagctgagcatcattccgtatgagatcacactgctgtctccctgtttgcatatgttacctcatcttcactttggcctcaaagacaaggtaagcgttcttggcctcctagctgtggcctcctagctttctgtttgttttatcatacctttggatcagacataccagtgatttctaactgctgcttttggtttagggaaacaaggtatcgccagagatacttggacttgatcctgaatgactttgtgaggcagaaatttatcatccgctctaagatcatcacatatataagaagtttcttagatgagctgggattcctagaggtaaggagagttccttgcctgacgtgatgagctgccttgcaatgcttgcctcctc

SEQ ID NO: 361873 - DNA, 902 bp, Homo sapiens
gggtctcctgtttatatgtgcttccctctttcctggtcaactgtttcttctatgtcgggtttccttcaattgtgcgcaacgagtgttctttctggttcccttcccggctcggtctgctcccttccgcttgagcttctgggaggaggggctcaccggcgcgtcccccagcaggtacttatgctcctggccccgcaggtgcttgaggtagcggtccttcagggactgccacgagtgctgcgtgagcgagctcttctccatcgctttccacaaggcgttaccggtgacggagctgggcgagcgggcattttccttcacgtaggtaaggatggctacgtcgtccgcatccgtgaaggcgatccgcccggcgtgccgctgcggctccggctccgcggcgccctcggccagggccccgggctttgcttccgagccggtgtccgccgccgaggcggggcccagccgataggcctccagctccagcctctcgttgcgctccacgcagtccaggatgtactgcgtggagatgaaatcacccgaggcctcggccagcgcctccccgggctgggccagcagcacggccccgggctcctgcactcggcacacggtgccgccgccgtgcaggatgagcgtcgacagccgacgcttggccgggctgggccgcacgtagaaggacatggagctgccgtcgtccctcacgaacagagtcgaggaatgggtgggcccgttggggtctttgcccaaatccatcgcctccgccatgtctgacgccgagcactactagaagagctaccccctcgcgagcgcctggcacacagagctcaactgactgagctgtcaccgcagacgcctctgccgcgaagcgcagcactgggcctgcgcagcagcagccgcggcgcatcgagagt

SEQ ID NO: 361874 - DNA, 645 bp, Homo sapiens
agcggaacgtactatcctccttacttttgggtcgggccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccataccctcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataa

SEQ ID NO: 361875 - DNA, 848 bp, Homo sapiens
cctgtactgtgatagccgcagagcagtagtaaagcaaacagagatcctgggcgcccggtgtggccccaggcgcgccggggggccccagattctaaggggtaccccacccaaaccgggtaccaattggcgcttccttccggggtccccacaagtccgcaatcgatccaatccggtccgtatcccgcctcggtctctccccttccgtgagcggagagggctcaccggcgcgtcccccagcaggtacttatgctcctggccccgcaggtgcttgaggtagcggtccttcagggactgccacgagtgctgcgtgagcgagctcttctccatcgctttccacaaggcgttaccggtgacggagctgggcgagcgggcattttccttcacgtaggtaaggatggctacgtcgtccgcatccgtgaaggcgatccgcccggcgtgccgctgcggctccggctccgcggcgccctcggccagggccccgggctttgcttccgagccggtgtccgccgccgaggcggggcccagccgataggcctccagctccagcctctcgttgcgctccacgcagtccaggatgtactgcgtggagatgaaatcacccgaggcgtagaaggacatggagctgccgtcgtccctcacgaacagagtcgaggaatgggtgggcccgttggggtctttgcccaaatccatcgcctccgccatgtctgacgccgagcactactagaagagctaccccctcgcgagcgcctggcacacagagctcaactgactgagctgtcaccgcagacgcctctgccgcgaagcgcagcactgggcctgcgcagcagcagccgcggcgcatcgagagt

SEQ ID NO: 361876 - DNA, 1893 bp, Homo sapiens
agcggaacgtactatcctccttacttttgggtcgggccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataa

SEQ ID NO: 361877 - DNA, 2236 bp, Homo sapiens
agcggaacgtactatcctccttacttttgggtcgggccctccgggaagatggcggccgtgcaggcggccgaggtgaaagtggatggcagcgagccgaaactgagcaagaagtggtggtaatcattagttccagggtgctctgccatgttgacgcaagctgctgtaaggcttgttagggggtccctgcgcaaaacctcctgggcagagtggggtcacagggaactgcgactgggtcaacttgctcctttcacagcgcctcacaaggacaagtcattttctgatcaaagaagtgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaattatgtctccccgacgcagtttgttattaatatgaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataa

SEQ ID NO: 361878 - DNA, 2139 bp, Homo sapiens
agcggaacgtactatcctccttacttttgggtcgggccctccgggaagatggcggccgtgcaggcggccgaggtgaaagtggatggcagcgagccgaaactgagcaagaagtggtggtaatcattagttccagggtgctctgccatgttgacgcaagctgctgtaaggcttgttagggggtccctgcgcaaaacctcctgggcagagtggggtcacagggaactgcgactgggtcaacttgctcctttcacagcgcctcacaaggacaagtcattttctgatcaaagaagtgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctgctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataa

SEQ ID NO: 361879 - DNA, 1959 bp, Homo sapiens
agcggaacgtactatcctccttacttttgggtcgggccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctgctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataa

SEQ ID NO: 361880 - DNA, 2522 bp, Homo sapiens
  misc_feature (2037)..(2037): n is a, c, g, or t
agcggaacgtactatcctccttacttttgggtcgggccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataaaaaaaaaaaaaaaaaaaaaaaaanaaaaaaaaaaaaaaaaaaaaaaaaaacacaaccacacacacaaaaaaaaaaaacaaaaaaaaaaaaaagaaaaataaaacgaaaaaaaaaaaaaacaaacaacacacacaggaatgggcggggcgcgcgcgccgacagcgagaaggagtagacacaacacaggaagggggggggggcgcgcccccccaagagttagaatggagcaaggtagtgagtcagcctgattgatctaacaaagaaaaacaagggagcgagacagaaagaagacagaggggggggtgtcatcacacaacaaaaaaaaaaaagcagcgcggggggggagagcacgacacggcggatggtggaagaacacagaccaaccacgaaggaggagggtggacgaggagagcagatacgaggagagggttaatcacacaaggagggcgagacgacacgagaggagagagaaaaaaaaaagacgccccgcgggaggagggggggaggac

SEQ ID NO: 361881 - DNA, 2050 bp, Homo sapiens
agcggaacgtactatcctccttacttttgggtcgggccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataacaaaaattttggaagagaaaaaaaaaagtcgtatcga

SEQ ID NO: 361882 - DNA, 1497 bp, Homo sapiens
agcggaacgtactatcctccttacttttgggtcgggccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcgttctagatcgcgagcggccgct

SEQ ID NO: 361883 - DNA, 1268 bp, Homo sapiens
  misc_feature (1268)..(1268): n is a, c, g, or t
agcggaacgtactatcctccttacttttgggtcgggccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcctcgacccgggttatgaactttggccggccgtccgcgatgccgggtttgttggcgccaattcctgggtttcccaccctgtgagttctatgggctatggaatttcccgatccctgggaatcccgggaaattggcccgggggtgggagcacattagggggtaagggccccaccccattgcccggccccctcatgttttttcccacctccgcgggacacggtaagcacgtaacccggggtgagcccgcacacccctatacagacacttccttcttcagtgtccgcacagn

SEQ ID NO: 361884 - DNA, 1207 bp, Homo sapiens
agcggaacgtactatcctccttacttttgggtcgggccctccgggaagatggcggccgtgcaggcggccgaggtgaaagtggatggcagcgagccgaaactgagcaagaagtggtggtaatcattagttccagggtgctctgccatgttgacgcaagctgctgtaaggcttgttagggggtccctgcgcaaaacctcctgggcagagtggggtcacagggaactgcgactgggtcaacttgctcctttcacagcgcctcacaaggacaagtcattttctgatcaaagaagtgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaagtcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataa

SEQ ID NO: 361885 - DNA, 736 bp, Homo sapiens
gggtctcctgtttatatgtgcttccctctttcctggtcaactgtttcttctatgtcgggtttccttcaattgtgcgcaacgagtgttctttctggttcccttcccggctcggtctgctcccttccgcttgagcttctgggaggaggggctcaccggcgcgtcccccagcaggtacttatgctcctggccccgcaggtgcttgaggtagcggtccttcagggactgccacgagtgctgcgtgagcgagctcttctccatcgctttccacaaggcgttaccggtgacggagctgggcgagcgggcattttccttcacgtaggtaaggatggctacgtcgtccgcatccgtgaaggcgatccgcccggcgtgccgctgcggctccggctccgcggcgccctcggccagggccccgggctttgcttccgagccggtgtccgccgccgaggcggggcccagccgataggcctccagctccagcctctcgttgcgctccacgcagtccaggatgtactgcgtggagatgaaatcacccgaggcgtagaaggacatggagctgccgtcgtccctcacgaacagagtcgaggaatgggtgggcccgttggggtctttgcccaaatccatcgcctccgccatgtctgacgccgagcactactagaagagctaccccctcgcgagcgcctgcctcgtgctattcctcaggcccggggatccactagtttagacagcccacccgtgg

SEQ ID NO: 361886 - DNA, 1822 bp, Homo sapiens
  misc_feature (222)..(222): n is a, c, g, or t
  misc_feature (293)..(293): n is a, c, g, or t
ataatgtgctgttcttgttattactgctattctgtgtcatcactctattccttctctactggatcattctcatcaacctaggatctctcttttttttttggagagagggtctcactctgtcactcaggctggagtgcagtggtgtgatcatagctcactgcagcctcgaactcctggcctcaatccatcctcctgcctcagcctccagagtagctgggaccncaggtgtacaccaccatgcccacctaatttttttttaaaaaaaggccaggcatggtggctcacacttgtgntcccagcactttgggtggccgaggcaggcagatcatgaggtcagaagttcgagaccagcctgaccaacatggtgaaaccccgtctctactaaaaatagaaaaattagccgggcatggtggcacacgcctgtaatcacggctactcaggaggctgaggcaggagaatcgcttgaacctgggaggcaaaggttgcagtgagctgagattatgccactgcactccagcctgggcaacagagtgagactccgtctcaaaaatatatatatatatttttttgtaggaacaatctcactttgttgcccagtctggcctcgaactcctggcttccaccagtccgcccgccttggcctcccaaagtggtggggttataggcatgaggcaccgttcctggccatctagtatctcttaatcaaaaccactgtttatcctcacatcccttccctaactgtatccccatttcttggctataattctcaagagttgtttgcatatgcttctactttatctcccattcacaaccaccaacatagatacatctctgttttttttccacttttttgagtgagtagttttatttttttcctgaggagctgtatcaaagtatcataaactggatggcttagagcaacaaaaatttattttctcaatgttttggaggcgtgaaattcacaatcaaggtgtcagcatgtccatgctcttttgaaggctctgtagaagaatcctttgttgcttcttccaagcttctggtggttgctggtaattcttggcattcattggcttgtagctgtataactccaatctctgccttcatcttcacatgaccatcttctctctttgtgtatccatataatcatcatctttttttttcgagacaggacctcactctgtcacccaggctggagtgtggtggcacaatcacaactcactgcagccttgacctcccaggcttaggtgatctttccatcacaacctcctaagtagctgggactacaggtgttgcaacaccatgcccagctaatttttctattttttgtagagacaggattttgtcatgttgtccaggctggtctcgaactcctgggctcatgatccacctgcctcggcctcccaagtgctgggattataagtgtgagccaccgtgcccagtctgatctttacttcttatgaggacttgagtcattggatttggggcccaccttaatccagtataacctcatcttaattacttcggcaaagaccctgtttccaaataaggccatatttcacagataccagggtataggacttcatatcgttttgagggacacaattcaacacataacattagttaagcgtctcatggagttcggactggttggggtgataatatttgtttctttttaagaatgtgcatttcctgccaggcacagtggctcattcctgtaataacagaactttgggaggccaaggcaggaggaggactgcttgagcccaggagttagaaaccagcctgggcaacagcaagaccctgtctccattaaaaaaaaaaa

SEQ ID NO: 361887 - DNA, 1768 bp, Homo sapiens
  misc_feature (222)..(222): n is a, c, g, or t
  misc_feature (293)..(293): n is a, c, g, or t
ataatgtgctgttcttgttattactgctattctgtgtcatcactctattccttctctactggatcattctcatcaacctaggatctctcttttttttttggagagagggtctcactctgtcactcaggctggagtgcagtggtgtgatcatagctcactgcagcctcgaactcctggcctcaatccatcctcctgcctcagcctccagagtagctgggaccncaggtgtacaccaccatgcccacctaatttttttttaaaaaaaggccaggcatggtggctcacacttgtgntcccagcactttgggtggccgaggcaggcagatcatgaggtcagaagttcgagaccagcctgaccaacatggtgaaaccccgtctctactaaaaatagaaaaattagccgggcatggtggcacacgcctgtaatcacggctactcaggaggctgaggcaggagaatcgcttgaacctgggaggcaaaggttgcagtgagctgagattatgccactgcactccagcctgggcaacagagtgagactccgtctcaaaaatatatatatatatttttttgtaggaacaatctcactttgttgcccagtctggcctcgaactcctggcttccaccagtccgcccgccttggcctcccaaagtggtggggttataggcatgaggcaccgttcctggccatctagtatctcttaatcaaaaccactgtttatcctcacatcccttccctaactgtatccccatttcttggctataattctcaagagttgtttgcatatgcttctactttatctcccattcacaaccaccaacatagatacatctctgttttttttccacttttttgagtgagtagttttatttttttcctgaggagctgtatcaaagtatcataaactggatggcttagagcaacacatgtccatgctcttttgaaggctctgtagaagaatcctttgttgcttcttccaagcttctggtggttgctggtaattcttggcattcattggcttgtagctgtataactccaatctctgccttcatcttcacatgaccatcttctctctttgtgtatccatataatcatcatctttttttttcgagacaggacctcactctgtcacccaggctggagtgtggtggcacaatcacaactcactgcagccttgacctcccaggcttaggtgatctttccatcacaacctcctaagtagctgggactacaggtgttgcaacaccatgcccagctaatttttctattttttgtagagacaggattttgtcatgttgtccaggctggtctcgaactcctgggctcatgatccacctgcctcggcctcccaagtgctgggattataagtgtgagccaccgtgcccagtctgatctttacttcttatgaggacttgagtcattggatttggggcccaccttaatccagtataacctcatcttaattacttcggcaaagaccctgtttccaaataaggccatatttcacagataccagggtataggacttcatatcgttttgagggacacaattcaacacataacattagttaagcgtctcatggagttcggactggttggggtgataatatttgtttctttttaagaatgtgcatttcctgccaggcacagtggctcattcctgtaataacagaactttgggaggccaaggcaggaggaggactgcttgagcccaggagttagaaaccagcctgggcaacagcaagaccctgtctccattaaaaaaaaaaa

SEQ ID NO: 361888 - DNA, 2628 bp, Homo sapiens
cggcagggccgagagcacgaccggcggaactcggacggcgcccagcggtcgcgggcgggatcgcagggcgaagccgagccgggccgggccctggcaggaaggggcggacccgcctgagtctcggatctggcttggctcgatcctccactctcccactccgctggggccgcccactggacatcgcccgagtcggcctggcggtcgtgccccaggacgcgccgaggtcctccgagcccgcagggggcgctgtcgccatatggcccaccctgagtcggcgcgggcaggaagtacgagggtcacttccggcgggggcgcggcttggactgaggagcggacccggccgggcgcaggggctggactggcggagcaggtggggtccgcggccgccggagcgttccggtcggcgtctgggcatctcggcctcggcagaaagcgcgaccgccctgctgcgcggggcccgcggcgatgccgttcctgcacggcttccggaggatcatcttcgagtaccagccgctggtggatgcgattctgggctccctggggatccaggaccccgagcggcaggagtctctggaccggcccagttatgtcgccagcgaggagagccgaatccttgttctcactgagctgctggagaggaaagcccactctcccttttaccaggaaggcgtcagcaacgccctgctcaagatggctgagctggggctgacgcgggcggccgacgttctcttgcggcatggggccaatctcaactttgaagacccagtcacctactacacggccttgcacatcgccgtcctgcggaaccagccggacatggtggagctgctggtgcatcacggggccgacgttaatcggagggaccggatccacgagagtagccccttggacctggccagcgaggagcctgagcgcctgccctgcctgcagcgcctcctggaccttggagctgatgtcaatgccgctgacaagcatggaaaaactgctctgctccatgctctggccagcagcgacggggtgcagatccacaatactgagaacattcgtctcttactggaaggaggggcagacgtcaaggccaccaccaaagatggggacacagtgttcacctgcatcatcttcctgcttggtgagaccgtgggaggggacaaagaggaggcccagatgatcaaccgcttctgcttccaagtcacacggctgctgctggcacacggggccgaccccagcgagtgcccagcccacgagtccctcacccacatctgcctgaagagctttaaactgcacttccctctcctgcgcttcctcctggagtccggagccgcctacaactgctccctgcacggtgcgtcctgctggtctggctttcacatcatctttgagaggctctgttcccacccaggctgcacggaagacgagagccatgcggacctcctgcgcaaagctgagactgtcctggatctcatggtgaccaactctcagaaactccagctgcccgaaaacttcgatatccaccctgtgggcagcctggcggaaaagatccaggccctccacttctccttgaggcagctggagagctatcccccgcccctcaagcacctgtgccgtgtggccatccggctctaccttcagccgtggcctgtggatgtgaaggtcaaagccctgcctctgcccgacaggctgaagtggtacctccttagcgagcacagtggctccgtggaagatgacatctgataggtctcaggctacaggaacgggggacacgggcagctcaggtcagcctgttggtagatgctgggacagcattagaagagggtctttttgatctgggagatgagacgggatccttcatgagaaaagccagccaggtagagcctgaagctgtgatcactccagtggtgaagggtgcagctctggttcttccagagagactgcccccttccctccagtggcactccaagtcccccccatgttggaaagaggaacagggcttggattgatgtttataccctctgaattggagggcagtgccagggcatttgcagaagctgggaaggaccaagcctcagcaccccagggctgcggggctcttgttggccgcacgtggcagtgcagctggagaggaagcctggggcacgtcctgtgcggtgccaccaaggccccacccctgccccttttccttccaggttctgttactcacagaagtgtttctggtgggctctgcgggagaagacactaagggccccacaggcttgtttcatggtgttgcaagccaagctggcccctgcctgttcctgtagctctggggccaggtcagccgtggccccacctaccagaactgtgctctgctggcagctgtgcttttgccaaacccagggcctcagcgaccatgacttctgctaaaaagcaatcatgagtgcgtggctggggacagacctctctgaagtgtctcctgttgtgaggggctcactttggagccactgaagagccgactgtgccacccacttgcgagcctcagtcccttccaagctgcactggtcattgggaattgtgtaaacacctctggggataagctgaggtgactaaatgatatatttatattataagattaaactgactttcttggcctta

SEQ ID NO: 361889 - DNA, 2519 bp, Homo sapiens
cggcagggccgagagcacgaccggcggaactcggacggcgcccagcggtcgcgggcgggatcgcagggcgaagccgagccgggccgggccctggcaggaaggggcggacccgcctgagtctcggatctggcttggctcgatcctccactctcccactccgctggggccgcccactggacatcgcccgagtcggcctggcggtcgtgccccaggacgcgccgaggtcctccgagcccgcagggggcgctgtcgccatatggcccaccctgagtcggcgcgggcaggaagtacgagggtcacttccggcgggggcgcggcttggactgaggagcggacccggccgggcgcaggggctggactggcggagcaggtggggtccgcggccgccggagcgttccggtcggcgtctgggcatctcggcctcggcagaaagcgcgaccgccctgctgcgcggggcccgcggcgatgccgttcctgcacggcttccggaggatcatcttcgagtaccagccgctggtggatgcgattctgggctccctggggatccaggaccccgagcggcaggagtctctggaccggcccagttatgtcgccagcgaggagagccgaatccttgttctcactgagctgctggagaggaaagcccactctcccttttaccaggaaggcgtcagcaacgccctgctcaagatggctgagctggggctgacgcgggcggccgacgttctcttgcggcatggggccaatctcaactttgaagacccagtcacctactacacggccttgcacatcgccgtcctgcggaaccagccggacatggtggagctgctggtgcatcacggggccgacgttaatcggagggaccgggaaaaactgctctgctccatgctctggccagcagcgacggggtgcagatccacaatactgagaacattcgtctcttactggaaggaggggcagacgtcaaggccaccaccaaagatggggacacagtgttcacctgcatcatcttcctgcttggtgagaccgtgggaggggacaaagaggaggcccagatgatcaaccgcttctgcttccaagtcacacggctgctgctggcacacggggccgaccccagcgagtgcccagcccacgagtccctcacccacatctgcctgaagagctttaaactgcacttccctctcctgcgcttcctcctggagtccggagccgcctacaactgctccctgcacggtgcgtcctgctggtctggctttcacatcatctttgagaggctctgttcccacccaggctgcacggaagacgagagccatgcggacctcctgcgcaaagctgagactgtcctggatctcatggtgaccaactctcagaaactccagctgcccgaaaacttcgatatccaccctgtgggcagcctggcggaaaagatccaggccctccacttctccttgaggcagctggagagctatcccccgcccctcaagcacctgtgccgtgtggccatccggctctaccttcagccgtggcctgtggatgtgaaggtcaaagccctgcctctgcccgacaggctgaagtggtacctccttagcgagcacagtggctccgtggaagatgacatctgataggtctcaggctacaggaacgggggacacgggcagctcaggtcagcctgttggtagatgctgggacagcattagaagagggtctttttgatctgggagatgagacgggatccttcatgagaaaagccagccaggtagagcctgaagctgtgatcactccagtggtgaagggtgcagctctggttcttccagagagactgcccccttccctccagtggcactccaagtcccccccatgttggaaagaggaacagggcttggattgatgtttataccctctgaattggagggcagtgccagggcatttgcagaagctgggaaggaccaagcctcagcaccccagggctgcggggctcttgttggccgcacgtggcagtgcagctggagaggaagcctggggcacgtcctgtgcggtgccaccaaggccccacccctgccccttttccttccaggttctgttactcacagaagtgtttctggtgggctctgcgggagaagacactaagggccccacaggcttgtttcatggtgttgcaagccaagctggcccctgcctgttcctgtagctctggggccaggtcagccgtggccccacctaccagaactgtgctctgctggcagctgtgcttttgccaaacccagggcctcagcgaccatgacttctgctaaaaagcaatcatgagtgcgtggctggggacagacctctctgaagtgtctcctgttgtgaggggctcactttggagccactgaagagccgactgtgccacccacttgcgagcctcagtcccttccaagctgcactggtcattgggaattgtgtaaacacctctggggataagctgaggtgactaaatgatatatttatattataagattaaactgactttcttggcctta

SEQ ID NO: 361890 - DNA, 2218 bp, Homo sapiens
gggcttcatggacttagatgaaagcgctaccgacccgttgcgcggacccgccgagaccccgattctgcaccgctaacgaaggatcacgttcctttaccatccggtggtgcaagccctactccaagaggtggggatccaggaccccgagcggcaggagtctctggaccggcccagttatgtcgccagcgaggagagccgaatccttgttctcactgagctgctggagaggaaagcccactctcccttttaccaggaaggcgtcagcaacgccctgctcaagatggctgagctggggctgacgcgggcggccgacgttctcttgcggcatggggccaatctcaactttgaagacccagtcacctactacacggccttgcacatcgccgtcctgcggaaccagccggacatggtggagctgctggtgcatcacggggccgacgttaatcggagggaccggatccacgagagtagccccttggacctggccagcgaggagcctgagcgcctgccctgcctgcagcgcctcctggaccttggagctgatgtcaatgccgctgacaagcatggaaaaactgctctgctccatgctctggccagcagcgacggggtgcagatccacaatactgagaacattcgtctcttactggaaggaggggcagacgtcaaggccaccaccaaagatggggacacagtgttcacctgcatcatcttcctgcttggtgagaccgtgggaggggacaaagaggaggcccagatgatcaaccgcttctgcttccaagtcacacggctgctgctggcacacggggccgaccccagcgagtgcccagcccacgagtccctcacccacatctgcctgaagagctttaaactgcacttccctctcctgcgcttcctcctggagtccggagccgcctacaactgctccctgcacggtgcgtcctgctggtctggctttcacatcatctttgagaggctctgttcccacccaggctgcacggaagacgagagccatgcggacctcctgcgcaaagctgagactgtcctggatctcatggtgaccaactctcagaaactccagctgcccgaaaacttcgatatccaccctgtgggcagcctggcggaaaagatccaggccctccacttctccttgaggcagctggagagctatcccccgcccctcaagcacctgtgccgtgtggccatccggctctaccttcagccgtggcctgtggatgtgaaggtcaaagccctgcctctgcccgacaggctgaagtggtacctccttagcgagcacagtggctccgtggaagatgacatctgataggtctcaggctacaggaacgggggacacgggcagctcaggtcagcctgttggtagatgctgggacagcattagaagagggtctttttgatctgggagatgagacgggatccttcatgagaaaagccagccaggtagagcctgaagctgtgatcactccagtggtgaagggtgcagctctggttcttccagagagactgcccccttccctccagtggcactccaagtcccccccatgttggaaagaggaacagggcttggattgatgtttataccctctgaattggagggcagtgccagggcatttgcagaagctgggaaggaccaagcctcagcaccccagggctgcggggctcttgttggccgcacgtggcagtgcagctggagaggaagcctggggcacgtcctgtgcggtgccaccaaggccccacccctgccccttttccttccaggttctgttactcacagaagtgtttctggtgggctctgcgggagaagacactaagggccccacaggcttgtttcatggtgttgcaagccaagctggcccctgcctgttcctgtagctctggggccaggtcagccgtggccccacctaccagaactgtgctctgctggcagctgtgcttttgccaaacccagggcctcagcgaccatgacttctgctaaaaagcaatcatgagtgcgtggctggggacagacctctctgaagtgtctcctgttgtgaggggctcactttggagccactgaagagccgactgtgccacccacttgcgagcctcagtcccttccaagctgcactggtcattgggaattgtgtaaacacctctggggataagctgaggtgactaaatgatatatttatattataagattaaactgactttcttggcctta

SEQ ID NO: 361891 - DNA, 692 bp, Homo sapiens
gcctgccctgcctgcagcgcctcctggaccttggagctgatgtcaatgccgctgacaagcatggtgggtgcctcctgcaggaaagcaggacagctgggcccccaggcaccttgtgggggacacccagggtgccccaggacaacagctaggtgggcagactggatgctggccctggctggtggcacagcatggctgggcacacagggattctgctgacttgctgagctcagaggcttcagagaggcagtgcagtcattgtccctgtgctggccctcaagggccttctataggaagaaatagggcatgtgtgcacttagtttccaagaaacaatggcttcccattgggagaggcccagccaacatctcaggtagcatcttggggtccagaaaaatcctacctttcctggcctttccgctcccacttctctgggtggaaagggaatggccagaagcctgtcaccctcagccctcacctgagctgagagttgtctctgaaagttcatcttctgatcctctgagtgtctggatttctgccacctcctctgggttgccctgacctgggcttcctggcctcctgctcctccttgctctccctccctccctaggaaaaactgctctgctccatgctctggccagcagcgacggggtgcagatccacaatactgagaacattcgtctcttactggaaggag

SEQ ID NO: 361892 - DNA, 3181 bp, Homo sapiens
cggcagggccgagagcacgaccggcggaactcggacggcgcccagcggtcgcgggcgggatcgcagggcgaagccgagccgggccgggccctggcaggaaggggcggacccgcctgagtctcggatctggcttggctcgatcctccactctcccactccgctggggccgcccactggacatcgcccgagtcggcctggcggtcgtgccccaggacgcgccgaggtcctccgagcccgcagggggcgctgtcgccatatggcccaccctgagtcggcgcgggcaggaagtacgagggtcacttccggcgggggcgcggcttggactgaggagcggacccggccgggcgcaggggctggactggcggagcaggtggggtccgcggccgccggagcgttccggtcggcgtctgggcatctcggcctcggcagaaagcgcgaccgccctgctgcgcggggcccgcggcgatgccgttcctgcacggcttccggaggatcatcttcgagtaccagccgctggtggatgcgattctgggctccctggggatccaggaccccgagcggcaggagtctctggaccggcccagttatgtcgccagcgaggagagccgaatccttgttctcactgagctgctggagaggaaagcccactctcccttttaccaggaaggcgtcagcaacgccctgctcaagatggctgagctggggctgacgcgggcggccgacgttctcttgcggcatggggccaatctcaactttgaagacccagtcacctactacacggccttgcacatcgccgtcctgcggaaccagccggacatggtggagctgctggtgcatcacggggccgacgttaatcggagggaccggatccacgagagtagccccttggacctggccagcgaggagcctgagcgcctgccctgcctgcagcgcctcctggaccttggagctgatgtcaatgccgctgacaagcatggaaaaactgctctgctccatgctctggccagcagcgacggggtgcagatccacaatactgagaacattcgtctcttactggaaggaggggcagacgtcaaggccaccaccaaagatggggacacagtgttcacctgcatcatcttcctgcttggtgagaccgtgggaggggacaaagaggaggcccagatgatcaaccgcttctgcttccaagtcacacggctgctgctggcacacggggccgaccccagcgagtgcccagcccacgagtccctcacccacatctgcctgaagagctttaaactgcacttccctctcctgcgcttcctcctggagtccggagccgcctacaactgctccctgcacggtgcgtcctgctggtctggctttcacatcatctttgagaggctctgttcccacccaggctgcacggaagacgagagccatgcggacctcctgcgcaaagctgagactgtcctggatctcatggtgaccaactctcagaaactccagctgcccgaaaacttcgatatccaccctgtgggcagcctggcggaaaagatccaggccctccacttctccttgaggcagctggagagctatcccccgcccctcaagcacctgtgccgtgtggccatccggctctaccttcagccgtggcctgtggatgtgaaggtcaaagccctgcctctgcccgacaggctgaagtggtacctccttagcgagcacagtggctccgtggaagatgacatctgataggtctcaggctacaggaacgggggacacgggcagctcaggtcagcctgttggtagatgctgggacagcattagaagagggtctttttgatctgggagatgagacgggatccttcatgagaaaagccagccaggtagagcctgaagctgtgatcactccagtggtgaagggtgcagctctggttcttccagagagactgcccccttccctccagtggcactccaagtcccccccatgttggaaagaggaacagggcttggattgatgtttataccctctgaattggagggcagtgccagggcatttgcagaagctgggaaggaccaagcctcagcaccccagggctgcggggctcttgttggccgcacgtggcagtgcagctggagaggaagcctggggcacgtcctgtgcggtgccaccaaggccccacccctgccccttttccttccaggttctgttactcacagaagtgtttctggtgggctctgcgggagaagacactaagggccccacaggcttgtttcatggtgttgcaagccaagctggcccctgcctgttcctgtagctctggggccaggtcagccgtggccccacctaccagaactgtgctctgctggcagctgtgcttttgccaaacccagggcctcagcgaccatgacttctgctaaaaagcaatcatgagtgcgtggctggggacagacctctctgaagtgtctcctgttgtgaggggctcactttggagccactgaagagccgactgtgccacccacttgcgagcctcagtcccttccaagctgcactggtcattgggaattgtgtaaacacctctggggataagctgaggtgactaaatgatatatttatattataagattaaactgactttcttggccttaacaaggtccttatataaaatttccaccccgcccctccatagttcaggatagaggctcccacagcagccggtaaggaagtgggtggcaggtgtgaggggatgctgtgtttggggggttgtttccaagtccctgcaaagaagcaccactctagactggcaagggcctccacagtgtggaggtcccattttattatttttttttttcgagacactctgtcacccaggctggagtgcaatggtgcaatctcggctcactgcgacctctgcctcccaggttcaagcagttctcctgcctcagcctcctgagtagctggcattataggtgcccaccaccatgcctggctgatttttgtatttttagtagagacggggtttcgccatgttggtcaggctggtctcaaactcctgacctcaggtgattcgcctgcctcggcctttcaaagtgctgggattacagacatgagccactgtgcccggcccccattttattttagttttattttgagacagagtctcgctctgtcacctaggctggagtgcagtggcgcaatctc

SEQ ID NO: 361893 - DNA, 570 bp, Homo sapiens
ggagcgttccggtcggcgtctgggcatctcggcctcggcagaaagcgcgaccgccctgctgcgcggggcccgcggcgatgccgttcctgcacggcttccggaggatcatcttcgagtaccagccgctggtggatgcgattctgggctccctggggatccaggaccccgagcggcaggagtctctggaccggtaactcaccccctcccgtgagctggccgaggccgctccgaccccgcagcgtcccactttatcaccacaagccgggcggggtggatgcgtcccccttgacagaggaagggacgggcggaagccggggttgcgtggctcggagtgcgcgctgccccgcgcggatcccactcctgccccttgcatggcggagacgaagggcggggagggcccgagggcggaggcccgcgggttgtcgcagggcctgcgcctcagccccaccctgtcgcctgcctgtcctgtgccaccccccggcgtggcagaggagcagggtggaatccgtgaggcctcagatgttaccccagagcagtgtgaaggtgggcttttgtagcagagtttgcgtt

SEQ ID NO: 361894 - DNA, 1490 bp, Homo sapiens
tttgacttaagaagccattttatggggaaattagaatgaatcttaaaaaagttttttttcttcttttgattgtattgaattcctttgtagtgtggcttttttaaaagactgaatctttgttctcattaaccctaggaaatgttcttgctttctctgcttatctctttgctctttaatatgaacagaattttttttactccctaaggaacgcaagccattttctgtttctagcactcccaccatgtcacgctcaagttcaataagtggtgttgatatggcaggactacagacatcttttctgtctcaggtgatgttttattttttatatgtgcttagttcttagaataataataaaggaaatatgcaaatggcaatattgtctgtcatcatgaccttgccattctatgggtaattcatctgaatacttgtggaggagtgctaattttagtgagaggaaacacgtgaatgattttctgcctttgagaagacatttaaagcaaaaattgacagaaccatttttgttcgaacctggtaatggaagacaagctatgataactgagtaactgtgtgaactttcttaattaacataggatgagtctcatgatcactcatttggaccaatgcctatatcagcaaatggaagcaatctttatgatgctgtaaggatgggagcaggatcaagcataattgaaaacctacagtctcagctaaagctaagggaaggggaaatcactcatttacaggtattggaaaaattaaatttgctatagaagtaaatgaagttttgaggcctaataaatagcacccttcatttccatctgaattctgagcaaattgagaaacaagatgacatagtggcatgtgaagcccaaaatgtatcacatatatcaatgataaaggctaaaaagagaaattagctaaggataacagccaactgaacctgctaattgccagaattaggcatattcggctgatctgtcacaggaaatgctgggctggagcaggcctcccatgttttacaacctgcctacataagacataagcatctaggagcagagaatccctcctcctttcaagcagctctttcccaacagaataaagggaagtcactgagctgtgaatgcctgttcatagatagagacaaaacatttctatcacaccggcaatttcctatgtgtcccatcccaatcaatcctttcccctttgctggctccaaacaatgactctttcctatctttttagaaagattagaattgcttttctagagttccagtaatggaatcatacagtgtctaagtctgtttgtggtgctgtaacaaaatacctgagactgggtaatttataaattataggaatttatttctcacagttctggatgctgaaaagtttatgatcaaggcactagcaggtttggtgtctgagggcccagtttctaatttgaagatggtgctttaaacactgtcctcacatggtagaaggggcagatgggc

SEQ ID NO: 361895 - DNA, 514 bp, Homo sapiens
gaaacattcctggtctcaagcattttgaaccaggatacctcttttcagtgttaaacacaatacactcagaagtaggtaaaaattcaactcccattatatacttttagttatatgaaaatattaaagaacttgaattggcaaaaagtagatcagactaatctgaatcccagatgtttgtatagctggtatgctatacagggacctaattaatttctttggtagtgatgaaagcctctgtcgatacaacctacacaggtggggctacgttaaagtatatttttatttctctgggttcttgtagtaatttagaataactgaaatatatgtcatttccttagattagaaaaatatatggttgaatgttttcaaacaaataattggatttatctctgttgcacagtaaaccttataaacggtatacctctcaggaaagttgggaccgtttttctgccactgtttcctttacttaagaaagagctagctcaaggttatatgttgacatgtctatttcaaa

SEQ ID NO: 361896 - DNA, 6888 bp, Homo sapiens
gtagatttggttgctgtgtacgtggaagaagcaagcgcatgcgcacatgggcccccttcgtctcagctgtgcgggaacggccgagggtaacatcccgggctcgcgggaggctgtcggggtaatggccacacgctgacagaaccagccgagtggaaaaggggagcgaagccgttcctctgcacccttccccaggcctgaggccttcccgcttggtgctgccgccgccactgccggctgaggaggggcgatgagttggttcaacgcctcccagctctccagcttcgctaagcaggccctgtcccaggcccagaagtctattgacagggttctggacatccaggaagaggagccgagcatctgggccgagaccattccgtatggagagccgggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttctacaccaataaatgaaggacagactgtgttagacaaggtggctgagcagtgtgaacctgctgaaagtcagccagaagcactttctgagaaggaagatgtttgcaagacagttgaatttctgaatgaaaagctggaaaaaagggaggctcagttattatctcttagtaaggaaaaagcacttctagaagaagcttttgataacctgaaagatgaaatgttcagagtgaaagaagaaagcagtagcatttcttccttgaaagatgagtttactcaaagaattgcagaagcagaaaagaaagttcaactagcctgcaaagagagagatgctgctaaaaaggaaatcaaaaacataaaagaagaacttgccactagattaaatagtagtgaaactgcagaccttttgaaagagaaagatgagcagatccgagggttaatggaagaaggagaaaaactttcaaaacagcagctgcacaattctaacatcatcaagaaattaagagctaaagacaaggagaatgaaaatatggttgcaaagctgaacaaaaaagttaaagagctagaagaggagttgcagcatttgaaacaggtccttgatggcaaagaagaggttgagaaacaacatagagaaaatattaaaaaactaaattccatggtagaacgccaagagaaagatcttggccgtcttcaggtagacatggatgaacttgaagaaaagaaccgaagtattcaggctgccctggatagtgcatacaaagaacttactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtgggggaccttaggcttgcattgcagcgtacagaacaagcggctgccagaaaggaggattatttacgccatgagatcggtgaacttcagcagagactccaggaagcagagaatcgaaaccaggaactgagtcaaagtgtttcatcaacaacaagaccattgcttcgacaaatagaaaatttgcaagcaaccctgggatcccagacatcgtcgtgggagaaattagagaagaatctttctgataggcttggtgaatcccagaccttgctggcagcagcagttgagagagaacgtgcagctacagaagaactccttgctaacaaaattcagatgtcttccatggagtcacagaattctcttttaagacaggaaaacagtagatttcaagcccagctagaatcagagaaaaataggctgtgtaaactggaggatgagaacaataggtaccaggttgaattggaaaacctaaaagatgaatatgtaagaacacttgaagagacgaggaaagaaaagacattgttgaatagtcagttagaaatggaaagaatgaaagttgaacaagaaaggaagaaagccatttttactcaagaaacaataaaagaaaaggaacgcaagccattttctgtttctagcactcccaccatgtcacgctcaagttcaataagtggtgttgatatggcaggactacagacatcttttctgtctcaggatgagtctcatgatcactcatttggaccaatgcctatatcagcaaatggaagcaatctttatgatgctgtaaggatgggagcaggatcaagcataattgaaaacctacagtctcagctaaagctaagggaaggggaaatcactcatttacagctagaaattggcaatctagaaaaaactcgatcaataatggctgaagaactagttaaattaacaaatcaaaatgatgaacttgaagagaaggtgaaggagatacccaaacttagaactcagctaagagatttggatcaaaggtacaacactattctgcagatgtatggagaaaaagcagaagaggcagaagaacttcgattagatctcgaagatgtaaaaaatatgtacaaaactcaaatagatgaacttttaagacaaagtctcagttaacttgtgaaaattgaattcccatcaaactgaatgtaagcatttaatatctaaacatttaatgtggacttccaataaattcttttatagaattagaaagtgggatttactgtagagtgtaaaaatttttttaaaattgttttacactatgtagtaatatttacagttaaattattttgtgcaatatttgaactttatttttgaaactattctttaaagatttattttttaaagcattcattttttttccttgaatagcacagagatttattactttatcctcatataaatatggctagagaagaagaatggtgttcatatatgtattgtagatatacaactagttgtatctataatttgtaagtgtttatatatatattaagaacatttgaagagtaatgttaacatactgaaactttgaaatctttcacatttaaaatttcaacatatcttaattactgctcatgaaaatgtacattaagtgttaaagtaaaaaattattaaatctgtggctattaaattttaaactaatttttttcctttaaaagtaagagtcacactgacactgtctgaaatttaaagagtgaatgatttaaacttaaaaaaaattttgatctgaaaatttatttcacccagctttcacaattaagtctgtataaaatgtggtaccttttggtacctatccagagaaacctgtacatattcaatgttatctagatgtgattggataatggagaaaatttatttataatgattttgcaatggcatcaataacatttaaatgattttgaagaagtattattttactaccctataaaatgaatcgaaaataataaagttcttaacataatttactctttaaaaattacctgttcatattttgtaaacccatatttttagcacattaaaaatgaatgtttgatattacagaatattcataacaaaatggaagaattataggaattaacttgaatttggcatttttaattttgtgatttatcattttattttttcttgaaatttcaaacacaaggaaagcatagaatagcttttaaaagtagctatgccttcttccaaatgttattttattcaaaaaggtaaccaggttgtgttttaaacctgtgaaatattgtgatgcattttattactgaaagttatttaactgcctttacttgcacataaaaactctcatttacggccaggtgctgtggctcatgcctgtaatcccagcactttgggaggccaaggcgggcatatcacctgatgtcaggagttcaagaccagcatggccagcagtttggtgaaaccccatctctactaaaaatacaaaaattagcctggcgtggtggtgtgcgcctgtaatcctagctactcgggaggctgaggcaggagcattgcttgaacctgggaggtggaggttacaatgagccaagattgtgccactgcactccagcatgggtgacagagaaagactccgtctcaaaaaaaaaaaaaacaaactcttatttaatttttagttaaaattaaaacactagtacttcagaatatagatacaagtacaccatcttgaagaatttggagtttttcagggcaattcaaatgacctcattttttgttctttttgtattccagacagtgtttctgtcattggatctctgattggtagtgttaataaatattctttcagtgtgagccagattcataaaattaattttcttcattttagtagtaaaaagtagtctaatagctttttgtcagcttgatttttttgtgtgtgtaatattcaagggcagaatgacaggacagataagcaataagaaatgtatagaattagaaaatatagtagttccctcttacccatgggacatacgttccaagacccccagtgaacgtctgaaaccatggatagtatagacacctctatacactgttttttcctatacatatatacctatgataaagttctatttataaatcagggacagcaagagataaacaataactgcaaatagaacaattataacagtgcactgtaataaaagtgatgtaaatgtgatatgtctgtctctttctctcaaaatatcttattgtactgtactcacctgtaatcagactgtggttgaccgtgagtaaccgaaaccacagaaagcaaaatcgtggataaggggagactactctatatgaaacttaagttacaaaattctctgaagcatttgaaactagacgttttggaattataaaatagtccctttaaaatatccactagtagaaaaaaacttcatttgcagagaaaagattgcaataaaactcattcctaaacttttcaattttataaaattaaacattctttttttatccgtattaacaatttctagttacatagtttctagttacatattaccatatattactctttatctacaaataaatagctgatactcaaactgatcatattttgattgttaaacacttggatctctcaatacttctgtaagttaaagtgaacttaaacagtttcttgaaaaactccagtaggtggcagaatacctattgaatattcgttgctatactttgctgtttgtcattaaaacatctctacccatattcttgcaaaataatatttatattttaatggataggaaaatgatttgcaattagatgtttccattcttgaaagaaaaaagctgcaaataacattttcaagaatataaaaaaatgagtaaccaaagggaaggttgtttggtcatttatagacaattaagcacagactgtagatgtccttccaattcttgggaggctaaactgagtctaccatttcttacatttcttttacctattttttgagaattgccagttgtacagtgtttagcatgtggaatgtaccaaatatatctatgttgtgacttaagatattctaaatgtggataacttctgacctaggaaacatgaagtttgtagtgaagtaagtgaaaagaatgttcaggaaattttttttctccatctcttcagttggcatttattgagagttttatttgaatgcttattaaaagtatatgatttataatatttagaaaatagaagaaaaaagaaaactgtagatgttttatcttgttttaatactgtatgtttagtacgtatacatttatgttctagtgtatcaaaatttttcattttcattaaagtgaatccaattttccatattctaggtccattttaaaccatgaaaactttaatcacatattttgtaaagggctgaaagtatgatttaaactacagattgatatattttaattctaaatgaaaggtaatgtaaataagcatggatctgattgaataaagattttaaaatagtaaaaatgtat

SEQ ID NO: 361897 - DNA, 4898 bp, Homo sapiens
gtagatttggttgctgtgtacgtggaagaagcaagcgcatgcgcacatgggcccccttcgtctcagctgtgcgggaacggccgagggtaacatcccgggctcgcgggaggctgtcggggtaatggccacacgctgacagaaccagccgagtggaaaaggggagcgaagccgttcctctgcacccttccccaggcctgaggccttcccgcttggtgctgccgccgccactgccggctgaggaggggcgatgagttggttcaacgcctcccagctctccagcttcgctaagcaggccctgtcccaggcccagaagtctattgacagggttctggacatccaggaagaggagccgagcatctgggccgagaccattccgtatggagagccgggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttctacaccaataaatgaaggacagactgtgttagacaaggtggctgagcagtgtgaacctgctgaaagtcagccagaagcactttctgagaaggaagatgtttgcaagacagttgaatttctgaatgaaaagctggaaaaaagggaggctcagttattatctcttagtaaggaaaaagcacttctagaagaagcttttgataacctgaaagatgaaatgttcagagtgaaagaagaaagcagtagcatttcttccttgaaagatgagtttactcaaagaattgcagaagcagaaaagaaagttcaactagcctgcaaagagagagatgctgctaaaaaggaaatcaaaaacataaaagaagaacttgccactagattaaatagtagtgaaactgcagaccttttgaaagagaaagatgagcagatccgagggttaatggaagaaggagaaaaactttcaaaacagcagctgcacaattctaacatcatcaagaaattaagagctaaagacaaggagaatgaaaatatggttgcaaagctgaacaaaaaagttaaagagctagaagaggagttgcagcatttgaaacaggtccttgatggcaaagaagaggttgagaaacaacatagagaaaatattaaaaaactaaattccatggtagaacgccaagagaaagatcttggccgtcttcaggtagacatggatgaacttgaagaaaagaaccgaagtattcaggctgccctggatagtgcatacaaagaacttactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtgggggaccttaggcttgcattgcagcgtacagaacaagcggctgccagaaaggaggattatttacgccatgagatcggtgaacttcagcagagactccaggaagcagagaatcgaaaccaggaactgagtcaaagtgtttcatcaacaacaagaccattgcttcgacaaatagaaaatttgcaagcaaccctgggatcccagacatcgtcgtgggagaaattagagaagaatctttctgataggcttggtgaatcccagaccttgctggcagcagcagttgagagagaacgtgcagctacagaagaactccttgctaacaaaattcagatgtcttccatggagtcacagaattctcttttaagacaggaaaacagtagatttcaagcccagctagaatcagagaaaaataggctgtgtaaactggaggatgagaacaataggtaccaggttgaattggaaaacctaaaagatgaatatgtaagaacacttgaagagacgaggaaagaaaagacattgttgaatagtcagttagaaatggaaagaatgaaagttgaacaagaaaggaagaaagccatttttactcaagaaacaataaaagaaaaggaacgcaagccattttctgtttctagcactcccaccatgtcacgctcaagttcaataagtggtgttgatatggcaggactacagacatcttttctgtctcaggatgagtctcatgatcactcatttggaccaatgcctatatcagcaaatggaagcaatctttatgatgctgtaaggatgggagcaggatcaagcataattgaaaacctacagtctcagctaaagctaagggaaggggaaatcactcatttacagctagaaattggcaatctagaaaaaactcgatcaataatggctgaagaactagttaaattaacaaatcaaaatgatgaacttgaagagaaggtgaaggagatacccaaacttagaactcagctaagagatttggatcaaaggtacaacactattctgcagatgtatggagaaaaagcagaagaggcagaagaacttcgattagatctcgaagatgtaaaaaatatgtacaaaactcaaatagatgaacttttaagacaaagtctcagttaacttgtgaaaattgaattcccatcaaactgaatgtaagcatttaatatctaaacatttaatgtggacttccaataaattcttttatagaattagaaagtgggatttactgtagagtgtaaaaatttttttaaaattgttttacactatgtagtaatatttacagttaaattattttgtgcaatatttgaactttatttttgaaactattctttaaagatttattttttaaagcattcattttttttccttgaatagcacagagatttattactttatcctcatataaatatggctagagaagaagaatggtgttcatatatgtattgtagatatacaactagttgtatctataatttgtaagtgtttatatatatattaagaacatttgaagagtaatgttaacatactgaaactttgaaatctttcacatttaaaatttcaacatatcttaattactgctcatgaaaatgtacattaagtgttaaagtaaaaaattattaaatctgtggctattaaattttaaactaatttttttcctttaaaagtaagagtcacactgacactgtctgaaatttaaagagtgaatgatttaaacttaaaaaaaattttgatctgaaaatttatttcacccagctttcacaattaagtctgtataaaatgtggtaccttttggtacctatccagagaaacctgtacatattcaatgttatctagatgtgattggataatggagaaaatttatttataatgattttgcaatggcatcaataacatttaaatgattttgaagaagtattattttactaccctataaaatgaatcgaaaataataaagttcttaacataatttactctttaaaaattacctgttcatattttgtaaacccatatttttagcacattaaaaatgaatgtttgatattacagaatattcataacaaaatggaagaattataggaattaacttgaatttggcatttttaattttgtgatttatcattttattttttcttgaaatttcaaacacaaggaaagcatagaatagcttttaaaagtagctatgccttcttccaaatgttattttattcaaaaaggtaaccaggttgtgttttaaacctgtgaaatattgtgatgcattttattactgaaagttatttaactgcctttacttgcacataaaaactctcatgcctcggccgggccccccaaaaatggttgggattccaggggtgagggaccaaggccggccaaactttattcttttaaatgtggatgtctagggtttcccaaggatctgttaaaaatgttactctttctccattggattattttgggcacccttataaacaatcaattgcccataaaaaaa

SEQ ID NO: 361898 - DNA, 4280 bp, Homo sapiens
agagcaccaataaataaaatgcacagaagtggagctttttcacttttggtttggtttctgagtgaaactcagatgggatctggaacacactgttggaaaatcactgatgtcaagctggtaataaaaatgatttctcaatatgtagctggagttaataaagtactgagtttttaatagtctatactagcatctttttcattttctgtttttttaaattctgccttgtttaataggtaccaggttgaattggaaaacctaaaagatgaatatgtaagaacacttgaagagacgaggaaagaaaagacattgttgaatagtcagttagaaatggaaagaatgaaagttgaacaagaaaggaagaaagccatttttactcaagaaacaataaaagaaaaggaacgcaagccattttctgtttctagcactcccaccatgtcacgctcaagttcaataagtggtgttgatatggcaggactacagacatcttttctgtctcaggatgagtctcatgatcactcatttggaccaatgcctatatcagcaaatggaagcaatctttatgatgctgtaaggatgggagcaggatcaagcataattgaaaacctacagtctcagctaaagctaagggaaggggaaatcactcatttacagctagaaattggcaatctagaaaaaactcgatcaataatggctgaagaactagttaaattaacaaatcaaaatgatgaacttgaagagaaggtgaaggagatacccaaacttagaactcagctaagagatttggatcaaaggtacaacactattctgcagatgtatggagaaaaagcagaagaggcagaagaacttcgattagatctcgaagatgtaaaaaatatgtacaaaactcaaatagatgaacttttaagacaaagtctcagttaacttgtgaaaattgaattcccatcaaactgaatgtaagcatttaatatctaaacatttaatgtggacttccaataaattcttttatagaattagaaagtgggatttactgtagagtgtaaaaatttttttaaaattgttttacactatgtagtaatatttacagttaaattattttgtgcaatatttgaactttatttttgaaactattctttaaagatttattttttaaagcattcattttttttccttgaatagcacagagatttattactttatcctcatataaatatggctagagaagaagaatggtgttcatatatgtattgtagatatacaactagttgtatctataatttgtaagtgtttatatatatattaagaacatttgaagagtaatgttaacatactgaaactttgaaatctttcacatttaaaatttcaacatatcttaattactgctcatgaaaatgtacattaagtgttaaagtaaaaaattattaaatctgtggctattaaattttaaactaatttttttcctttaaaagtaagagtcacactgacactgtctgaaatttaaagagtgaatgatttaaacttaaaaaaaattttgatctgaaaatttatttcacccagctttcacaattaagtctgtataaaatgtggtaccttttggtacctatccagagaaacctgtacatattcaatgttatctagatgtgattggataatggagaaaatttatttataatgattttgcaatggcatcaataacatttaaatgattttgaagaagtattattttactaccctataaaatgaatcgaaaataataaagttcttaacataatttactctttaaaaattacctgttcatattttgtaaacccatatttttagcacattaaaaatgaatgtttgatattacagaatattcataacaaaatggaagaattataggaattaacttgaatttggcatttttaattttgtgatttatcattttattttttcttgaaatttcaaacacaaggaaagcatagaatagcttttaaaagtagctatgccttcttccaaatgttattttattcaaaaaggtaaccaggttgtgttttaaacctgtgaaatattgtgatgcattttattactgaaagttatttaactgcctttacttgcacataaaaactctcatttacggccaggtgctgtggctcatgcctgtaatcccagcactttgggaggccaaggcgggcatatcacctgatgtcaggagttcaagaccagcatggccagcagtttggtgaaaccccatctctactaaaaatacaaaaattagcctggcgtggtggtgtgcgcctgtaatcctagctactcgggaggctgaggcaggagcattgcttgaacctgggaggtggaggttacaatgagccaagattgtgccactgcactccagcatgggtgacagagaaagactccgtctcaaaaaaaaaaaaaacaaactcttatttaatttttagttaaaattaaaacactagtacttcagaatatagatacaagtacaccatcttgaagaatttggagtttttcagggcaattcaaatgacctcattttttgttctttttgtattccagacagtgtttctgtcattggatctctgattggtagtgttaataaatattctttcagtgtgagccagattcataaaattaattttcttcattttagtagtaaaaagtagtctaatagctttttgtcagcttgatttttttgtgtgtgtaatattcaagggcagaatgacaggacagataagcaataagaaatgtatagaattagaaaatatagtagttccctcttacccatgggacatacgttccaagacccccagtgaacgtctgaaaccatggatagtatagacacctctatacactgttttttcctatacatatatacctatgataaagttctatttataaatcagggacagcaagagataaacaataactgcaaatagaacaattataacagtgcactgtaataaaagtgatgtaaatgtgatatgtctgtctctttctctcaaaatatcttattgtactgtactcacctgtaatcagactgtggttgaccgtgagtaaccgaaaccacagaaagcaaaatcgtggataaggggagactactctatatgaaacttaagttacaaaattctctgaagcatttgaaactagacgttttggaattataaaatagtccctttaaaatatccactagtagaaaaaaacttcatttgcagagaaaagattgcaataaaactcattcctaaacttttcaattttataaaattaaacattctttttttatccgtattaacaatttctagttacatagtttctagttacatattaccatatattactctttatctacaaataaatagctgatactcaaactgatcatattttgattgttaaacacttggatctctcaatacttctgtaagttaaagtgaacttaaacagtttcttgaaaaactccagtaggtggcagaatacctattgaatattcgttgctatactttgctgtttgtcattaaaacatctctacccatattcttgcaaaataatatttatattttaatggataggaaaatgatttgcaattagatgtttccattcttgaaagaaaaaagctgcaaataacattttcaagaatataaaaaaatgagtaaccaaagggaaggttgtttggtcatttatagacaattaagcacagactgtagatgtccttccaattcttgggaggctaaactgagtctaccatttcttacatttcttttacctattttttgagaattgccagttgtacagtgtttagcatgtggaatgtaccaaatatatctatgttgtgacttaagatattctaaatgtggataacttctgacctaggaaacatgaagtttgtagtgaagtaagtgaaaagaatgttcaggaaattttttttctccatctcttcagttggcatttattgagagttttatttgaatgcttattaaaagtatatgatttataatatttagaaaatagaagaaaaaagaaaactgtagatgttttatcttgttttaatactgtatgtttagtacgtatacatttatgttctagtgtatcaaaatttttcattttcattaaagtgaatccaattttccatattctaggtccattttaaaccatgaaaactttaatcacatattttgtaaagggctgaaagtatgatttaaactacagattgatatattttaattctaaatgaaaggtaatgtaaataagcatggatctgattgaataaagattttaaaatagtaaaaatgtat

SEQ ID NO: 361899 - DNA, 3142 bp, Homo sapiens
atgtatgtagatatatgaacaccattcttcttctctagccatatttatatgaggataaagtaataaatctctgtgctagagaagaagaatggtgttcatatatgtattgtagatatacaactagttgtatctataatttgtaagtgtttatatatatattaagaacatttgaagagtaatgttaacatactgaaactttgaaatctttcacatttaaaatttcaacatatcttaattactgctcatgaaaatgtacattaagtgttaaagtaaaaaattattaaatctgtggctattaaattttaaactaatttttttcctttaaaagtaagagtcacactgacactgtctgaaatttaaagagtgaatgatttaaacttaaaaaaaattttgatctgaaaatttatttcacccagctttcacaattaagtctgtataaaatgtggtaccttttggtacctatccagagaaacctgtacatattcaatgttatctagatgtgattggataatggagaaaatttatttataatgattttgcaatggcatcaataacatttaaatgattttgaagaagtattattttactaccctataaaatgaatcgaaaataataaagttcttaacataatttactctttaaaaattacctgttcatattttgtaaacccatatttttagcacattaaaaatgaatgtttgatattacagaatattcataacaaaatggaagaattataggaattaacttgaatttggcatttttaattttgtgatttatcattttattttttcttgaaatttcaaacacaaggaaagcatagaatagcttttaaaagtagctatgccttcttccaaatgttattttattcaaaaaggtaaccaggttgtgttttaaacctgtgaaatattgtgatgcattttattactgaaagttatttaactgcctttacttgcacataaaaactctcatttacggccaggtgctgtggctcatgcctgtaatcccagcactttgggaggccaaggcgggcatatcacctgatgtcaggagttcaagaccagcatggccagcagtttggtgaaaccccatctctactaaaaatacaaaaattagcctggcgtggtggtgtgcgcctgtaatcctagctactcgggaggctgaggcaggagcattgcttgaacctgggaggtggaggttacaatgagccaagattgtgccactgcactccagcatgggtgacagagaaagactccgtctcaaaaaaaaaaaaaacaaactcttatttaatttttagttaaaattaaaacactagtacttcagaatatagatacaagtacaccatcttgaagaatttggagtttttcagggcaattcaaatgacctcattttttgttctttttgtattccagacagtgtttctgtcattggatctctgattggtagtgttaataaatattctttcagtgtgagccagattcataaaattaattttcttcattttagtagtaaaaagtagtctaatagctttttgtcagcttgatttttttgtgtgtgtaatattcaagggcagaatgacaggacagataagcaataagaaatgtatagaattagaaaatatagtagttccctcttacccatgggacatacgttccaagacccccagtgaacgtctgaaaccatggatagtatagacacctctatacactgttttttcctatacatatatacctatgataaagttctatttataaatcagggacagcaagagataaacaataactgcaaatagaacaattataacagtgcactgtaataaaagtgatgtaaatgtgatatgtctgtctctttctctcaaaatatcttattgtactgtactcacctgtaatcagactgtggttgaccgtgagtaaccgaaaccacagaaagcaaaatcgtggataaggggagactactctatatgaaacttaagttacaaaattctctgaagcatttgaaactagacgttttggaattataaaatagtccctttaaaatatccactagtagaaaaaaacttcatttgcagagaaaagattgcaataaaactcattcctaaacttttcaattttataaaattaaacattctttttttatccgtattaacaatttctagttacatagtttctagttacatattaccatatattactctttatctacaaataaatagctgatactcaaactgatcatattttgattgttaaacacttggatctctcaatacttctgtaagttaaagtgaacttaaacagtttcttgaaaaactccagtaggtggcagaatacctattgaatattcgttgctatactttgctgtttgtcattaaaacatctctacccatattcttgcaaaataatatttatattttaatggataggaaaatgatttgcaattagatgtttccattcttgaaagaaaaaagctgcaaataacattttcaagaatataaaaaaatgagtaaccaaagggaaggttgtttggtcatttatagacaattaagcacagactgtagatgtccttccaattcttgggaggctaaactgagtctaccatttcttacatttcttttacctattttttgagaattgccagttgtacagtgtttagcatgtggaatgtaccaaatatatctatgttgtgacttaagatattctaaatgtggataacttctgacctaggaaacatgaagtttgtagtgaagtaagtgaaaagaatgttcaggaaattttttttctccatctcttcagttggcatttattgagagttttatttgaatgcttattaaaagtatatgatttataatatttagaaaatagaagaaaaaagaaaactgtagatgttttatcttgttttaatactgtatgtttagtacgtatacatttatgttctagtgtatcaaaatttttcattttcattaaagtgaatccaattttccatattctaggtccattttaaaccatgaaaactttaatcacatattttgtaaagggctgaaagtatgatttaaactacagattgatatattttaattctaaatgaaaggtaatgtaaataagcatggatctgattgaataaagattttaaaatagtaaaaatgtat

SEQ ID NO: 361900 - DNA, 4006 bp, Homo sapiens
gtagatttggttgctgtgtacgtggaagaagcaagcgcatgcgcacatgggcccccttcgtctcagctgtgcgggaacggccgagggtaacatcccgggctcgcgggaggctgtcggggtaatggccacacgctgacagaaccagccgagtggaaaaggggagcgaagccgttcctctgcacccttccccaggcctgaggccttcccgcttggtgctgccgccgccactgccggctgaggaggggcgatgagttggttcaacgcctcccagctctccagcttcgctaagcaggccctgtcccaggcccagaagtctattgacagggttctggacatccaggaagaggagccgagcatctgggccgagaccattccgtatggagagccgggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttctacaccaataaatgaaggacagactgtgttagacaaggtggctgagcagtgtgaacctgctgaaagtcagccagaagcactttctgagaaggaagatgtttgcaagacagttgaatttctgaatgaaaagctggaaaaaagggaggctcagttattatctcttagtaaggaaaaagcacttctagaagaagcttttgataacctgaaagatgaaatgttcagagtgaaagaagaaagcagtagcatttcttccttgaaagatgagtttactcaaagaattgcagaagcagaaaagaaagttcaactagcctgcaaagagagagatgctgctaaaaaggaaatcaaaaacataaaagaagaacttgccactagattaaatagtagtgaaactgcagaccttttgaaagagaaagatgagcagatccgagggttaatggaagaaggagaaaaactttcaaaacagcagctgcacaattctaacatcatcaagaaattaagagctaaagacaaggagaatgaaaatatggttgcaaagctgaacaaaaaagttaaagagctagaagaggagttgcagcatttgaaacaggtccttgatggcaaagaagaggttgagaaacaacatagagaaaatattaaaaaactaaattccatggtagaacgccaagagaaagatcttggccgtcttcaggtagacatggatgaacttgaagaaaagaaccgaagtattcaggctgccctggatagtgcatacaaagaacttactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtgggggaccttaggcttgcattgcagcgtacagaacaagcggctgccagaaaggaggattatttacgccatgagatcggtgaacttcagcagagactccaggaagcagagaatcgaaaccaggaactgagtcaaagtgtttcatcaacaacaagaccattgcttcgacaaatagaaaatttgcaagcaaccctgggatcccagacatcgtcgtgggagaaattagagaagaatctttctgataggcttggtgaatcccagaccttgctggcagcagcagttgagagagaacgtgcagctacagaagaactccttgctaacaaaattcagatgtcttccatggagtcacagaattctcttttaagacaggaaaacagtagatttcaagcccagctagaatcagagaaaaataggctgtgtaaactggaggatgagaacaataggtaccaggttgaattggaaaacctaaaagatgaatatgtaagaacacttgaagagacgaggaaagaaaagacattgttgaatagtcagttagaaatggaaagaatgaaagttgaacaagaaaggaagaaagccatttttactcaagaaacaataaaagaaaaggaacgcaagccattttctgtttctagcactcccaccatgtcacgctcaagttcaataagtggtgttgatatggcaggactacagacatcttttctgtctcaggatgagtctcatgatcactcatttggaccaatgcctatatcagcaaatggaagcaatctttatgatgctgtaaggatgggagcaggatcaagcataattgaaaacctacagtctcagctaaagctaagggaaggggaaatcactcatttacaggtattggaaaaattaaatttgctatagaagtaaatgaagttttgaggcctaataaatagcacccttcatttccatctgaattctgagcaaattgagaaacaagatgacatagtggcatgtgaagcccaaaatgtatcacatatatcaatgataaaggctaaaaagagaaattagctaaggataacagccaactgaacctgctaattgccagaattaggcatattcggctgatctgtcacaggaaatgctgggctggagcaggcctcccatgttttacaacctgcctacataagacataagcatctaggagcagagaatccctcctcctttcaagcagctctttcccaacagaataaagggaagtcactgagctgtgaatgcctgttcatagatagagacaaaacatttctatcacaccggcaatttcctatgtgtcccatcccaatcaatcctttcccctttgctggctccaaacaatgactctttcctatctttttagaaagattagaattgcttttctagagttccagtaatggaatcatacagtgtctaagtctgtttgtggtgctgtaacaaaatacctgagactgggtaatttataaattataggaatttatttctcacagttctggatgctgaaaagtttatgatcaaggcactagcaggtttggtgtctgagggcccagtttctaatttgaagatggtgctttaaacactgtcctcacatggtagaaggggcagatgggc

SEQ ID NO: 361901 - DNA, 4005 bp, Homo sapiens
gtagatttggttgctgtgtacgtggaagaagcaagcgcatgcgcacatgggcccccttcgtctcagctgtgcgggaacggccgagggtaacatcccgggctcgcgggaggctgtcggggtaatggccacacgctgacagaaccagccgagtggaaaaggggagcgaagccgttcctctgcacccttccccaggcctgaggccttcccgcttggtgctgccgccgccactgccggctgaggaggggcgatgagttggttcaacgcctcccagctctccagcttcgctaagcaggccctgtcccaggcccagaagtctattgacagggttctggacatccaggaagaggagccgagcatctgggccgagaccattccgtatggagagccgggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttctacaccaataaatgaaggacagactgtgttagacaaggtggctgagcagtgtgaacctgctgaaagtcagccagaagcactttctgagaaggaagatgtttgcaagacagttgaatttctgaatgaaaagctggaaaaaagggaggctcagttattatctcttagtaaggaaaaagcacttctagaagaagcttttgataacctgaaagatgaaatgttcagagtgaaagaagaaagcagtagcatttcttccttgaaagatgagtttactcaaagaattgcagaagcagaaaagaaagttcaactagcctgcaaagagagagatgctgctaaaaaggaaatcaaaaacataaaagaagaacttgccactagattaaatagtagtgaaactgcagaccttttgaaagagaaagatgagcagatccgagggttaatggaagaaggagaaaaactttcaaaacagcagctgcacaattctaacatcatcaagaaattaagagctaaagacaaggagaatgaaaatatggttgcaaagctgaacaaaaaagttaaagagctagaagaggagttgcagcatttgaaacaggtccttgatggcaaagaagaggttgagaaacaacatagagaaaatattaaaaaactaaattccatggtagaacgccaagagaaagatcttggccgtcttcaggtagacatggatgaacttgaagaaaagaaccgaagtattcaggctgccctggatagtgcatacaaagaacttactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtgggggaccttaggcttgcattgcagcgtacagaacaagcggctgccagaaaggaggattatttacgccatgagatcggtgaacttcagcagagactccaggaagcagagaatcgaaaccaggaactgagtcaaagtgtttcatcaacaacaagaccattgcttcgacaaatagaaaatttgcaagcaaccctgggatcccagacatcgtcgtgggagaaattagagaagaatctttctgataggcttggtgaatcccagaccttgctggcagcagcagttgagagagaacgtgcagctacagaagaactccttgctaacaaaattcagatgtcttccatggagtcacagaattctcttttaagacaggaaaacagtagatttcaagcccagctagaatcagagaaaaataggctgtgtaaactggaggatgagaacaataggtaccaggttgaattggaaaacctaaaagatgaatatgtaagaacacttgaagagacgaggaaagaaaagacattgttgaatagtcagttagaaatggaaagaatgaaagttgaacaagaaaggaagaaagccatttttactcaagaaacaataaaagaaaaggaacgcaagccattttctgtttctagcactcccaccatgtcacgctcaagttcaataagtggtgttgatatggcaggactacagacatcttttctgtctcaggatgagtctcatgatcactcatttggaccaatgcctatatcagcaaatggaagcaatctttatgatgctgtaaggatgggagcaggatcaagcataattgaaaacctacagtctcagctaaagctaagggaaggggaaatcactcatttacaggtattggaaaaattaaatttgctatagaagtaaatgaagttttgaggcctaataaatagcacccttcatttccatctgaattctgagcaaattgagaaacaagatgacatagtggcatgtgaagcccaaaatgtatcacatatatcaatgataaaggctaaaaagagaaattagctaaggataacagccaactgaacctgctaattgccagaattaggcatattcggctgatctgtcacaggaaatgctgggctggagcaggcctcccatgttttacaacctgcctacataagacataagcatctaggagcagagaatccctcctcctttcaagcagctctttcccaacagaataaagggaagtcactgagctgtgaatgcctgttctattcagatttacctcttagataagttgttccagctaccccgggaaggaggggtaaaggggatgagatgtttgaactgtaacaccctgtacatgggaggaaacaacatgagttgttgatggagcatccttccatcttacctttttggccttcccccaacctcaggcagtccagatcatggatatggtagacaggttcattcattccagttgagtgatgtaaagggcccagtaatcaggaatttggagtgttggccaccagctcaaaggcagtgggataatgcgctgggcggagtcccgagtttcgcatgcccggccagtgagtccataaggcatttttacccatatcttaggccaaaag

SEQ ID NO: 361902 - DNA, 2068 bp, Homo sapiens
ttgttgagacggagtctcactccgtcgcccaggctggagtgcagtggcgcgatctcggctcactgtaatcctagctactcgggaggctgaggcaggagcattgcttgaacctgggaggtggaggttacaatgagccaagattgtgccactgcactccagcatgggtgacagagaaagactccgtctcaaaaaaaaaaaaaacaaactcttatttaatttttagttaaaattaaaacactagtacttcagaatatagatacaagtacaccatcttgaagaatttggagtttttcagggcaattcaaatgacctcattttttgttctttttgtattccagacagtgtttctgtcattggatctctgattggtagtgttaataaatattctttcagtgtgagccagattcataaaattaattttcttcattttagtagtaaaaagtagtctaatagctttttgtcagcttgatttttttgtgtgtgtaatattcaagggcagaatgacaggacagataagcaataagaaatgtatagaattagaaaatatagtagttccctcttacccatgggacatacgttccaagacccccagtgaacgtctgaaaccatggatagtatagacacctctatacactgttttttcctatacatatatacctatgataaagttctatttataaatcagggacagcaagagataaacaataactgcaaatagaacaattataacagtgcactgtaataaaagtgatgtaaatgtgatatgtctgtctctttctctcaaaatatcttattgtactgtactcacctgtaatcagactgtggttgaccgtgagtaaccgaaaccacagaaagcaaaatcgtggataaggggagactactctatatgaaacttaagttacaaaattctctgaagcatttgaaactagacgttttggaattataaaatagtccctttaaaatatccactagtagaaaaaaacttcatttgcagagaaaagattgcaataaaactcattcctaaacttttcaattttataaaattaaacattctttttttatccgtattaacaatttctagttacatagtttctagttacatattaccatatattactctttatctacaaataaatagctgatactcaaactgatcatattttgattgttaaacacttggatctctcaatacttctgtaagttaaagtgaacttaaacagtttcttgaaaaactccagtaggtggcagaatacctattgaatattcgttgctatactttgctgtttgtcattaaaacatctctacccatattcttgcaaaataatatttatattttaatggataggaaaatgatttgcaattagatgtttccattcttgaaagaaaaaagctgcaaataacattttcaagaatataaaaaaatgagtaaccaaagggaaggttgtttggtcatttatagacaattaagcacagactgtagatgtccttccaattcttgggaggctaaactgagtctaccatttcttacatttcttttacctattttttgagaattgccagttgtacagtgtttagcatgtggaatgtaccaaatatatctatgttgtgacttaagatattctaaatgtggataacttctgacctaggaaacatgaagtttgtagtgaagtaagtgaaaagaatgttcaggaaattttttttctccatctcttcagttggcatttattgagagttttatttgaatgcttattaaaagtatatgatttataatatttagaaaatagaagaaaaaagaaaactgtagatgttttatcttgttttaatactgtatgtttagtacgtatacatttatgttctagtgtatcaaaatttttcattttcattaaagtgaatccaattttccatattctaggtccattttaaaccatgaaaactttaatcacatattttgtaaagggctgaaagtatgatttaaactacagattgatatattttaattctaaatgaaaggtaatgtaaataagcatggatctgattgaataaagattttaaaatagtaaaaatgtat

SEQ ID NO: 361903 - DNA, 2072 bp, Homo sapiens
gtagatttggttgctgtgtacgtggaagaagcaagcgcatgcgcacatgggcccccttcgtctcagctgtgcgggaacggccgagggtaacatcccgggctcgcgggaggctgtcggggtaatggccacacgctgacagaaccagccgagtggaaaaggggagcgaagccgttcctctgcacccttccccaggcctgaggccttcccgcttggtgctgccgccgccactgccggctgaggaggggcgatgagttggttcaacgcctcccagctctccagcttcgctaagcaggccctgtcccaggcccagaagtctattgacagggttctggacatccaggaagaggagccgagcatctgggccgagaccattccgtatggagagccgggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttctacaccaataaatgaaggacagactgtgttagacaaggtggctgagcagtgtgaacctgctgaaagtcagccagaagcactttctgagaaggaagatgtttgcaaggtaactctagtaagtggaagggatttttagatgtgctttttggagattaaatcatttgttttaaaaaatactttcattgatgcataataatttatacagatttaaaaacatacgcattttgccatttctgtgtagcattaagtaccttgaagttgaacaattattaatataatttggaatttctccaaggcaattatggtagaataagttgatacttcaatacagttaagcatgaaagttttcatcttacatctttatttttgagtccttatcacttcaaaattctgttatgcttattagtatgtcaatttgaaaggaatattttcttacattaacatgtatcttcacctcctttgcagatagatgtgccaaaaaaactaaatgttatggtttttcttgtatcagaatttgtttttacatgtttacattatttgtagcaaatattaaatgataatttaagattttaattattggtgct

SEQ ID NO: 361904 - DNA, 218 bp, Homo sapiens
tactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtaagcaatggatgatgaattagagtagttttaaaaatatttgtttatgcttctacaaattaaacaa

SEQ ID NO: 361905 - DNA, 427 bp, Homo sapiens
aaagagtgataaagcaggtataagttaagattggttcatttgtctcagtagacagtcctgccttaggcaataaatagttatcagttttaagtgtggctacttgcatcattaaatgtttgaaatcagaattgacttggtattttggtctctgggctgtatgtgtatgtgatttttttttctgtcctgtaatcaggtgaatcccagaccttgctggcagcagcagttgagagagaacgtgcagctacagaagaactccttgctaacaaaattcagatgtcttccatggagtcacagaattctcttttaagacaggaaaacagtagatttcaagcccagctagaatcagagaaaaataggctgtgtaaactggaggatgagaacaataggtgagcatggtttctgagtgatatttttggtagttccgtga

SEQ ID NO: 361906 - DNA, 6525 bp, Homo sapiens
gtagatttggttgctgtgtacgtggaagaagcaagcgcatgcgcacatgggcccccttcgtctcagctgtgcgggaacggccgagggtaacatcccgggctcgcgggaggctgtcggggtaatggccacacgctgacagaaccagccgagtggaaaaggggagcgaagccgttcctctgcacccttccccaggcctgaggccttcccgcttggtgctgccgccgccactgccggctgaggaggggcgatgagttggttcaacgcctcccagctctccagcttcgctaagcaggccctgtcccaggcccagaagtctattgacagggttctggacatccaggaagaggagccgagcatctgggccgagaccattccgtatggagagccgggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttctacaccaataaatgaaggacagactgtgttagacaaggtggctgagcagtgtgaacctgctgaaagtcagccagaagcactttctgagaaggaagatgtttgcaagacagttgaatttctgaatgaaaagctggaaaaaagggaggctcagttattatctcttagtaaggaaaaagcacttctagaagaagcttttgataacctgaaagatgaaatgttcagagtgaaagaagaaagcagtagcatttcttccttgaaagatgagtttactcaaagaattgcagaagcagaaaagaaagttcaactagcctgcaaagagagagatgctgctaaaaaggaaatcaaaaacataaaagaagaacttgccactagattaaatagtagtgaaactgcagaccttttgaaagagaaagatgagcagatccgagggttaatggaagaaggagaaaaactttcaaaacagcagctgcacaattctaacatcatcaagaaattaagagctaaagacaaggagaatgaaaatatggttgcaaagctgaacaaaaaagttaaagagctagaagaggagttgcagcatttgaaacaggtccttgatggcaaagaagaggttgagaaacaacatagagaaaatattaaaaaactaaattccatggtagaacgccaagagaaagatcttggccgtcttcaggtagacatggatgaacttgaagaaaagaaccgaagtattcaggctgccctggatagtgcatacaaagaacttactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtgggggaccttaggcttgcattgcagcgtacagaacaagcggctgccagaaaggaggattatttacgccatgagatcggtgaacttcagcagagactccaggaagcagagaatcgaaaccaggaactgagtcaaagtgtttcatcaacaacaagaccattgcttcgacaaatagaaaatttgcaagcaaccctgggatcccagacatcgtcgtgggagaaattagagaagaatctttctgataggcttggtgaatcccagaccttgctggcagcagcagttgagagagaacgtgcagctacagaagaactccttgctaacaaaattcagatgtcttccatggagtcacagaattctcttttaagacaggaaaacagtagatttcaagcccagctagaatcagagaaaaataggctgtgtaaactggaggatgagaacaataggtaccaggttgaattggaaaacctaaaagatgaatatgtaagaacacttgaagagacgaggaaagaaaagacattgttgaatagtcagttagaaatggaaagaatgaaagttgaacaagaaaggaagaaagccatttttactcaagaaacaataaaagaaaaggaacgcaagccattttctgtttctagcactcccaccatgtcacgctcaagttcaataagtggtgttgatatggcaggactacagacatcttttctgtctcaggatgagtctcatgatcactcatttggaccaatgcctatatcagcaaatggaagcaatctttatgatgctgtaaggatgggagcaggatcaagcataattgaaaacctacagtctcagctaaagctaagggaaggggaaatcactcatttacagctagaaattggcaatctagaaaaaactcgatcaataatggctgaagaactagttaaattaacaaatcaaaatgatgaacttgaagagaaggtgaaggagatacccaaacttagaactcagctaagagatttggatcaaaggtacaacactattctgcagatgtatggagaaaaagcagaagaggcagaagaacttcgattagatctcgaagatgtaaaaaatatgtacaaaactcaaatagatgaacttttaagacaaagtctcagttaacttgtgaaaattgaattcccatcaaactgaatgtaagcatttaatatctaaacatttaatgtggacttccaataaattcttttatagaattagaaagtgggatttactgtagagtgtaaaaatttttttaaaattgttttacactatgtagtaatatttacagttaaattattttgtgcaatatttgaactttatttttgaaactattctttaaagatttattttttaaagcattcattttttttccttgaatagcacagagatttattactttatcctcatataaatatggctagagaagaagaatggtgttcatatatgtattgtagatatacaactagttgtatctataatttgtaagtgtttatatatatattaagaacatttgaagagtaatgttaacatactgaaactttgaaatctttcacatttaaaatttcaacatatcttaattactgctcatgaaaatgtacattaagtgttaaagtaaaaaattattaaatctgtggctattaaattttaaactaatttttttcctttaaaagtaagagtcacactgacactgtctgaaatttaaagagtgaatgatttaaacttaaaaaaaattttgatctgaaaatttatttcacccagctttcacaattaagtctgtataaaatgtggtaccttttggtacctatccagagaaacctgtacatattcaatgttatctagatgtgattggataatggagaaaatttatttataatgattttgcaatggcatcaataacatttaaatgattttgaagaagtattattttactaccctataaaatgaatcgaaaataataaagttcttaacataatttactctttaaaaattacctgttcatattttgtaaacccatatttttagcacattaaaaatgaatgtttgatattacagaatattcataacaaaatggaagaattataggaattaacttgaatttggcatttttaattttgtgatttatcattttattttttcttgaaatttcaaacacaaggaaagcatagaatagcttttaaaagtagctatgccttcttccaaatgttattttattcaaaaaggtaaccaggttgtgttttaaacctgtgaaatattgtgatgcattttattactgaaagttatttaactgcctttacttgcacataaaaactctcatttacggccaggtgctgtggctcatgcctgtaatcccagcactttgggaggccaaggcgggcatatcacctgatgtcaggagttcaagaccagcatggccagcagtttggtgaaaccccatctctactaaaaatacaaaaattagcctggcgtggtggtgtgcgcctgtaatcctagctactcgggaggctgaggcaggagcattgcttgaacctgggaggtggaggttacaatgagccaagattgtgccactgcactccagcatgggtgacagagaaagactccgtctcaaaaaaaaaaaaaacaaactcttatttaatttttagttaaaattaaaacactagtacttcagaatatagatacaagtacaccatcttgaagaatttggagtttttcagggcaattcaaatgacctcattttttgttctttttgtattccagacagtgtttctgtcattggatctctgattggtagtgttaataaatattctttcagtgtgagccagattcataaaattaattttcttcattttagtagtaaaaagtagtctaatagctttttgtcagcttgatttttttgtgtgtgtaatattcaagggcagaatgacaggacagataagcaataagaaatgtatagaattagaaaatatagtagttccctcttacccatgggacatacgttccaagacccccagtgaacgtctgaaaccatggatagtatagacacctctatacactgttttttcctatacatatatacctatgataaagttctatttataaatcagggacagcaagagataaacaataactgcaaatagaacaattataacagtgcactgtaataaaagtgatgtaaatgtgatatgtctgtctctttctctcaaaatatcttattgtactgtactcacctgtaatcagactgtggttgaccgtgagtaaccgaaaccacagaaagcaaaatcgtggataaggggagactactctatatgaaacttaagttacaaaattctctgaagcatttgaaactagacgttttggaattataaaatagtccctttaaaatatccactagtagaaaaaaacttcatttgcagagaaaagattgcaataaaactcattcctaaacttttcaattttataaaattaaacattctttttttatccgtattaacaatttctagttacatagtttctagttacatattaccatatattactctttatctacaaataaatagctgatactcaaactgatcatattttgattgttaaacacttggatctctcaatacttctgtaagttaaagtgaacttaaacagtttcttgaaaaactccagtaggtggcagaatacctattgaatattcgttgctatactttgctgtttgtcattaaaacatctctacccatattcttgcaaaataatatttatattttaatggataggaaaatgatttgcaattagatgtttccattcttgaaagaaaaaagctgcaaataacattttcaagaatataaaaaaatgagtaaccaaagggaaggttgtttggtcatttatagacaattaagcacagactgtagatgtccttccaattcttgggaggctaaactgagtctaccatttcttacatttcttttacctattttttgagaattgccagttgtacagtgtttagcatgtggaatgtaccaaatatatagtgaagtaagtgaaaagaatgttcaggaaattttttttctccaaacaggatcctcaagctgctgccatgaactaaggaactattagagctcatgcgatccttgctg

SEQ ID NO: 361907 - DNA, 6668 bp, Homo sapiens
cattccaaggagctgcggatgaagctggagaagctttagagatgagcgtggatggaagccaagcggaagatctccagcctgtccttcaccctggaggaggaagaatagggaggcgtggaggaagaggagccgagcatctgggccgagaccattccgtatggagagccgggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttctacaccaataaatgaaggacagactgtgttagacaaggtggctgagcagtgtgaacctgctgaaagtcagccagaagcactttctgagaaggaagatgtttgcaagacagttgaatttctgaatgaaaagctggaaaaaagggaggctcagttattatctcttagtaaggaaaaagcacttctagaagaagcttttgataacctgaaagatgaaatgttcagagtgaaagaagaaagcagtagcatttcttccttgaaagatgagtttactcaaagaattgcagaagcagaaaagaaagttcaactagcctgcaaagagagagatgctgctaaaaaggaaatcaaaaacataaaagaagaacttgccactagattaaatagtagtgaaactgcagaccttttgaaagagaaagatgagcagatccgagggttaatggaagaaggagaaaaactttcaaaacagcagctgcacaattctaacatcatcaagaaattaagagctaaagacaaggagaatgaaaatatggttgcaaagctgaacaaaaaagttaaagagctagaagaggagttgcagcatttgaaacaggtccttgatggcaaagaagaggttgagaaacaacatagagaaaatattaaaaaactaaattccatggtagaacgccaagagaaagatcttggccgtcttcaggtagacatggatgaacttgaagaaaagaaccgaagtattcaggctgccctggatagtgcatacaaagaacttactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtgggggaccttaggcttgcattgcagcgtacagaacaagcggctgccagaaaggaggattatttacgccatgagatcggtgaacttcagcagagactccaggaagcagagaatcgaaaccaggaactgagtcaaagtgtttcatcaacaacaagaccattgcttcgacaaatagaaaatttgcaagcaaccctgggatcccagacatcgtcgtgggagaaattagagaagaatctttctgataggcttggtgaatcccagaccttgctggcagcagcagttgagagagaacgtgcagctacagaagaactccttgctaacaaaattcagatgtcttccatggagtcacagaattctcttttaagacaggaaaacagtagatttcaagcccagctagaatcagagaaaaataggctgtgtaaactggaggatgagaacaataggtaccaggttgaattggaaaacctaaaagatgaatatgtaagaacacttgaagagacgaggaaagaaaagacattgttgaatagtcagttagaaatggaaagaatgaaagttgaacaagaaaggaagaaagccatttttactcaagaaacaataaaagaaaaggaacgcaagccattttctgtttctagcactcccaccatgtcacgctcaagttcaataagtggtgttgatatggcaggactacagacatcttttctgtctcaggatgagtctcatgatcactcatttggaccaatgcctatatcagcaaatggaagcaatctttatgatgctgtaaggatgggagcaggatcaagcataattgaaaacctacagtctcagctaaagctaagggaaggggaaatcactcatttacagctagaaattggcaatctagaaaaaactcgatcaataatggctgaagaactagttaaattaacaaatcaaaatgatgaacttgaagagaaggtgaaggagatacccaaacttagaactcagctaagagatttggatcaaaggtacaacactattctgcagatgtatggagaaaaagcagaagaggcagaagaacttcgattagatctcgaagatgtaaaaaatatgtacaaaactcaaatagatgaacttttaagacaaagtctcagttaacttgtgaaaattgaattcccatcaaactgaatgtaagcatttaatatctaaacatttaatgtggacttccaataaattcttttatagaattagaaagtgggatttactgtagagtgtaaaaatttttttaaaattgttttacactatgtagtaatatttacagttaaattattttgtgcaatatttgaactttatttttgaaactattctttaaagatttattttttaaagcattcattttttttccttgaatagcacagagatttattactttatcctcatataaatatggctagagaagaagaatggtgttcatatatgtattgtagatatacaactagttgtatctataatttgtaagtgtttatatatatattaagaacatttgaagagtaatgttaacatactgaaactttgaaatctttcacatttaaaatttcaacatatcttaattactgctcatgaaaatgtacattaagtgttaaagtaaaaaattattaaatctgtggctattaaattttaaactaatttttttcctttaaaagtaagagtcacactgacactgtctgaaatttaaagagtgaatgatttaaacttaaaaaaaattttgatctgaaaatttatttcacccagctttcacaattaagtctgtataaaatgtggtaccttttggtacctatccagagaaacctgtacatattcaatgttatctagatgtgattggataatggagaaaatttatttataatgattttgcaatggcatcaataacatttaaatgattttgaagaagtattattttactaccctataaaatgaatcgaaaataataaagttcttaacataatttactctttaaaaattacctgttcatattttgtaaacccatatttttagcacattaaaaatgaatgtttgatattacagaatattcataacaaaatggaagaattataggaattaacttgaatttggcatttttaattttgtgatttatcattttattttttcttgaaatttcaaacacaaggaaagcatagaatagcttttaaaagtagctatgccttcttccaaatgttattttattcaaaaaggtaaccaggttgtgttttaaacctgtgaaatattgtgatgcattttattactgaaagttatttaactgcctttacttgcacataaaaactctcatttacggccaggtgctgtggctcatgcctgtaatcccagcactttgggaggccaaggcgggcatatcacctgatgtcaggagttcaagaccagcatggccagcagtttggtgaaaccccatctctactaaaaatacaaaaattagcctggcgtggtggtgtgcgcctgtaatcctagctactcgggaggctgaggcaggagcattgcttgaacctgggaggtggaggttacaatgagccaagattgtgccactgcactccagcatgggtgacagagaaagactccgtctcaaaaaaaaaaaaaacaaactcttatttaatttttagttaaaattaaaacactagtacttcagaatatagatacaagtacaccatcttgaagaatttggagtttttcagggcaattcaaatgacctcattttttgttctttttgtattccagacagtgtttctgtcattggatctctgattggtagtgttaataaatattctttcagtgtgagccagattcataaaattaattttcttcattttagtagtaaaaagtagtctaatagctttttgtcagcttgatttttttgtgtgtgtaatattcaagggcagaatgacaggacagataagcaataagaaatgtatagaattagaaaatatagtagttccctcttacccatgggacatacgttccaagacccccagtgaacgtctgaaaccatggatagtatagacacctctatacactgttttttcctatacatatatacctatgataaagttctatttataaatcagggacagcaagagataaacaataactgcaaatagaacaattataacagtgcactgtaataaaagtgatgtaaatgtgatatgtctgtctctttctctcaaaatatcttattgtactgtactcacctgtaatcagactgtggttgaccgtgagtaaccgaaaccacagaaagcaaaatcgtggataaggggagactactctatatgaaacttaagttacaaaattctctgaagcatttgaaactagacgttttggaattataaaatagtccctttaaaatatccactagtagaaaaaaacttcatttgcagagaaaagattgcaataaaactcattcctaaacttttcaattttataaaattaaacattctttttttatccgtattaacaatttctagttacatagtttctagttacatattaccatatattactctttatctacaaataaatagctgatactcaaactgatcatattttgattgttaaacacttggatctctcaatacttctgtaagttaaagtgaacttaaacagtttcttgaaaaactccagtaggtggcagaatacctattgaatattcgttgctatactttgctgtttgtcattaaaacatctctacccatattcttgcaaaataatatttatattttaatggataggaaaatgatttgcaattagatgtttccattcttgaaagaaaaaagctgcaaataacattttcaagaatataaaaaaatgagtaaccaaagggaaggttgtttggtcatttatagacaattaagcacagactgtagatgtccttccaattcttgggaggctaaactgagtctaccatttcttacatttcttttacctattttttgagaattgccagttgtacagtgtttagcatgtggaatgtaccaaatatatctatgttgtgacttaagatattctaaatgtggataacttctgacctaggaaacatgaagtttgtagtgaagtaagtgaaaagaatgttcaggaaattttttttctccatctcttcagttggcatttattgagagttttatttgaatgcttattaaaagtatatgatttataatatttagaaaatagaagaaaaaagaaaactgtagatgttttatcttgttttaatactgtatgtttagtacgtatacatttatgttctagtgtatcaaaatttttcattttcattaaagtgaatccaattttccatattctaggtccattttaaaccatgaaaactttaatcacatattttgtaaagggctgaaagtatgatttaaactacagattgatatattttaattctaaatgaaaggtaatgtaaataagcatggatctgattgaataaagattttaaaatagtaaaaatgtat

SEQ ID NO: 361908 - DNA, 3998 bp, Homo sapiens
gtagatttggttgctgtgtacgtggaagaagcaagcgcatgcgcacatgggcccccttcgtctcagctgtgcgggaacggccgagggtaacatcccgggctcgcgggaggctgtcggggtaatggccacacgctgacagaaccagccgagtggaaaaggggagcgaagccgttcctctgcacccttccccaggcctgaggccttcccgcttggtgctgccgccgccactgccggctgaggaggggcgatgagttggttcaacgcctcccagctctccagcttcgctaagcaggccctgtcccaggcccagaagtctattgacagggttctggacatccaggaagaggagccgagcatctgggccgagaccattccgtatggagagccgggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttctacaccaataaatgaaggacagactgtgttagacaaggtggctgagcagtgtgaacctgctgaaagtcagccagaagcactttctgagaaggaagatgtttgcaagacagttgaatttctgaatgaaaagctggaaaaaagggaggctcagttattatctcttagtaaggaaaaagcacttctagaagaagcttttgataacctgaaagatgaaatgttcagagtgaaagaagaaagcagtagcatttcttccttgaaagatgagtttactcaaagaattgcagaagcagaaaagaaagttcaactagcctgcaaagagagagatgctgctaaaaaggaaatcaaaaacataaaagaagaacttgccactagattaaatagtagtgaaactgcagaccttttgaaagagaaagatgagcagatccgagggttaatggaagaaggagaaaaactttcaaaacagcagctgcacaattctaacatcatcaagaaattaagagctaaagacaaggagaatgaaaatatggttgcaaagctgaacaaaaaagttaaagagctagaagaggagttgcagcatttgaaacaggtccttgatggcaaagaagaggttgagaaacaacatagagaaaatattaaaaaactaaattccatggtagaacgccaagagaaagatcttggccgtcttcaggtagacatggatgaacttgaagaaaagaaccgaagtattcaggctgccctggatagtgcatacaaagaacttactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtgggggaccttaggcttgcattgcagcgtacagaacaagcggctgccagaaaggaggattatttacgccatgagatcggtgaacttcagcagagactccaggaagcagagaatcgaaaccaggaactgagtcaaagtgtttcatcaacaacaagaccattgcttcgacaaatagaaaatttgcaagcaaccctgggatcccagacatcgtcgtgggagaaattagagaagaatctttctgataggcttggtgaatcccagaccttgctggcagcagcagttgagagagaacgtgcagctacagaagaactccttgctaacaaaattcagatgtcttccatggagtcacagaattctcttttaagacaggaaaacagtagatttcaagcccagctagaatcagagaaaaataggctgtgtaaactggaggatgagaacaataggtaccaggttgaattggaaaacctaaaagatgaatatgtaagaacacttgaagagacgaggaaagaaaagacattgttgaatagtcagttagaaatggaaagaatgaaagttgaacaagaaaggaagaaagccatttttactcaagaaacaataaaagaaaaggaacgcaagccattttctgtttctagcactcccaccatgtcacgctcaagttcaataagtggtgttgatatggcaggactacagacatcttttctgtctcaggatgagtctcatgatcactcatttggaccaatgcctatatcagcaaatggaagcaatctttatgatgctgtaaggatgggagcaggatcaagcataattgaaaacctacagtctcagctaaagctaagggaaggggaaatcactcatttacaggtattggaaaaattaaatttgctatagaagtaaatgaagttttgaggcctaataaatagcacccttcatttccatctgaattctgagcaaattgagaaacaagatgacatagtggcatgtgaagcccaaaatgtatcacatatatcaatgataaaggctaaaaagagaaattagctaaggataacagccaactgaacctgctaattgccagaattaggcatattcggctgatctgtcacaggaaatgctgggctggagcaggcctcccatgttttacaacctgcctacataagacataagcatctaggagcagagaatccctcctcctttcaagcagctctttcccaacagaataaagggaagtcactgagctgtgaatgcctgttctattcagatttacctcttagataagttgttccagctaccccgggaaggaggggtaaaggggatgagatgtttgaactgtaacaccctgtacatgggaggaaacaacatgagttgttgatggagcatccttccatcttacctttttggcttttaaaaaactttatgcagtcagaaatattgaaatgttttacaggtttgagcatcccagctctgaaatctgaaatgcccccaaatccaaaactttgagtgctgacatgctgctcaaaggaaaagctcaattgagcattttggatttccagatttgggatgctcaaccagtaagtacataatgcaattattccataatctgaaa

SEQ ID NO: 361909 - DNA, 3373 bp, Homo sapiens
gtagatttggttgctgtgtacgtggaagaagcaagcgcatgcgcacatgggcccccttcgtctcagctgtgcgggaacggccgagggtaacatcccgggctcgcgggaggctgtcggggtaatggccacacgctgacagaaccagccgagtggaaaaggggagcgaagccgttcctctgcacccttccccaggcctgaggccttcccgcttggtgctgccgccgccactgccggctgaggaggggcgatgagttggttcaacgcctcccagctctccagcttcgctaagcaggccctgtcccaggcccagaagtctattgacagggttctggacatccaggaagaggagccgagcatctgggccgagaccattccgtatggagagccgggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttctacaccaataaatgaaggacagactgtgttagacaaggtggctgagcagtgtgaacctgctgaaagtcagccagaagcactttctgagaaggaagatgtttgcaagacagttgaatttctgaatgaaaagctggaaaaaagggaggctcagttattatctcttagtaaggaaaaagcacttctagaagaagcttttgataacctgaaagatgaaatgttcagagtgaaagaagaaagcagtagcatttcttccttgaaagatgagtttactcaaagaattgcagaagcagaaaagaaagttcaactagcctgcaaagagagagatgctgctaaaaaggaaatcaaaaacataaaagaagaacttgccactagattaaatagtagtgaaactgcagaccttttgaaagagaaagatgagcagatccgagggttaatggaagaaggagaaaaactttcaaaacagcagctgcacaattctaacatcatcaagaaattaagagctaaagacaaggagaatgaaaatatggttgcaaagctgaacaaaaaagttaaagagctagaagaggagttgcagcatttgaaacaggtccttgatggcaaagaagaggttgagaaacaacatagagaaaatattaaaaaactaaattccatggtagaacgccaagagaaagatcttggccgtcttcaggtagacatggatgaacttgaagaaaagaaccgaagtattcaggctgccctggatagtgcatacaaagaacttactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtgggggaccttaggcttgcattgcagcgtacagaacaagcggctgccagaaaggaggattatttacgccatgagatcggtgaacttcagcagagactccaggaagcagagaatcgaaaccaggaactgagtcaaagtgtttcatcaacaacaagaccattgcttcgacaaatagaaaatttgcaagcaaccctgggatcccagacatcgtcgtgggagaaattagagaagaatctttctgataggcttggtgaatcccagaccttgctggcagcagcagttgagagagaacgtgcagctacagaagaactccttgctaacaaaattcagatgtcttccatggagtcacagaattctcttttaagacaggaaaacagtagatttcaagcccagctagaatcagagaaaaataggctgtgtaaactggaggatgagaacaataggtaccaggttgaattggaaaacctaaaagatgaatatgtaagaacacttgaagagacgaggaaagaaaagacattgttgaatagtcagttagaaatggaaagaatgaaagttgaacaagaaaggaagaaagccatttttactcaagaaacaataaaagaaaaggaacgcaagccattttctgtttctagcactcccaccatgtcacgctcaagttcaataagtggtgttgatatggcaggactacagacatcttttctgtctcaggatgagtctcatgatcactcatttggaccaatgcctatatcagcaaatggaagcaatctttatgatgctgtaaggatgggagcaggatcaagcataattgaaaacctacagtctcagctaaagctaagggaaggggaaatcactcatttacagtaaaccttataaacggtatacctctcaggaaagttgggaccgtttttctgccactgtttcctttacttaagaaagagctagctcaaggttatatgttgacatgtctatttcaaa

SEQ ID NO: 361910 - DNA, 223 bp, Homo sapiens
caagaaaatatcaaatggttttactggcaagatctgccaaatattcaagaaacaagtaatttcaattttggacagaattttccagagaagagaaaatgggaagagggttgttcctcattttatgaagctagtatacacatcagtgccaacatttgacaagggaagtttgaaaaaggaaaatcaccgactaatctctcccatgagcagagacttaaaaaattct

SEQ ID NO: 361911 - DNA, 466 bp, Homo sapiens
gcctcatttgtatctgttatatgaaagttttaatcaccataaatatatttacaatgaagttggaaaatggaatttccccacctccttggatttgatttttctgttttactttatttctaaaagttacgaagctgggcatggtggctcacacctgtaatcccagcactttgggaggctgaggtgggcggataaccggagatcagaagtttgagaaaagcctggccaacatggcgaaaccccatttctactaaaaaacaaacaaaacaaaacaaacaaaaaacaaaaattagctgggtgttgtggtgggtgcctgtaatcccagctacttgggaggctgaggcaggagaatcccttgcgcctgtgatgcagaggttgcagtgagccaagatcgcaccactacactctagcttgggcaatagaacaaggctgtatctcaaaagaaaaaccacccccaaaaaacaaaaaa

SEQ ID NO: 361912 - DNA, 448 bp, Homo sapiens
tttgcggtcgcactagaggatccccgcctggaccctctctacaagtgcagctttttatagaaattctgaacagatatatctatttttatgaaaaggaaaatgatgcggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggtccaggcgcctggaccctctctcaattctaattggaccctaaatctaaagtcttacaaaacttttgtcttacaaattcaggagttcctggcatggcacagtggaaacaaatctg

SEQ ID NO: 361913 - DNA, 353 bp, Homo sapiens
  misc_feature (335)..(335): n is a, c, g, or t
ttgctccctggggactctaaaactaggtgctattgaaacttctaaaactcctagtttttagaagtttccatagccaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgatttttttttttgcaccagtgaaacaataaagatgctattgaaacttctaaaactaggggtaccggctcgantcgtatctgctctttctt

SEQ ID NO: 361914 - DNA, 5148 bp, Homo sapiens
agcgtcacatgaccgcgggaggctacgcgcggggcgggtgctgcttgctgcaggctctggggagtcgccatgcctacaacacagcagtcccctcaggatgagcaggaaaagctcttggatgaagccatacaggctgtgaaggtccagtcattccaaatgaagagatgcctggacaaaaacaagcttatggatgctctaaaacatgcttctaatatgcttggtgaactccggacttctatgttatcaccaaagagttactatgaactttatatggccatttctgatgaactgcactacttggaggtctacctgacagatgagtttgctaaaggaaggaaagtggcagatctctacgaacttgtacagtatgctggaaacattatcccaaggctttaccttttgatcacagttggagttgtatatgtcaagtcatttcctcagtccaggaaggatattttgaaagatttggtagaaatgtgccgtggtgtgcaacatcccttgaggggtctgtttcttcgaaattaccttcttcagtgtaccagaaatatcttacctgatgaaggagagccaacagatgaagaaacaactggtgacatcagtgattccatggattttgtactgctcaactttgcagaaatgaacaagctctgggtgcgaatgcagcatcagggacatagccgagatagagaaaaaagagaacgagaaagacaagaactgagaattttagtgggaacaaatttggtgcgcctcagtcagttggaaggtgtaaatgtggaacgttacaaacagattgttttgactggcatattggagcaagttgtaaactgtagggatgctttggctcaagaatatctcatggagtgtattattcaggttttccctgatgaatttcacctccagactttgaatccttttcttcgggcctgtgctgagttacaccagaatgtaaatgtgaagaacataatcattgctttaattgatagattagctttatttgctcaccgtgaagatggacctggaatcccagcggatattaaactttttgatatattttcacagcaggtggctacagtgatacagtctagacaagacatgccttcagaggatgttgtatctttacaagtctctctgattaatcttgccatgaaatgttaccctgatcgtgtggactatgttgataaagttctagaaacaacagtggagatattcaataagctcaaccttgaacatattgctaccagtagtgcagtttcaaaggaactcaccagacttttgaaaataccagttgacacttacaacaatattttaacagtcttgaaattaaaacattttcacccactctttgagtactttgactacgagtccagaaagagcatgagttgttatgtgcttagtaatgttctggattataacacagaaattgtctctcaagaccaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggcattttctctgtatgaagatgaaatcagcgattccaaagcacagctagctgccatcaccttgatcattggcacttttgaaaggatgaagtgcttcagtgaagagaatcatgaacctctgaggactcagtgtgcccttgctgcatccaaacttctaaagaaacctgatcagggccgagctgtgagcacctgtgcacatctcttctggtctggcagaaacacggacaaaaatggggaggagcttcacggaggcaagagggtaatggagtgcctaaaaaaagctctaaaaatagcaaatcagtgcatggacccctctctacaagtgcagctttttatagaaattctgaacagatatatctatttttatgaaaaggaaaatgatgcggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatctgtaagcacttatcttggctactaatgaagctctccttttttttgtttgtttgtttgcttcattgttgattgtgtattttcttcattcctggggagtactaacccaaaagcgtctgtctcttgttttctagtccagtttgagattaatttagaagaaaggaatactgtatgtgaaattcatcttgggctttcccctaaattgcaagataaggccatgtgtaagattttccctaaaactagaatatattaatgcatgtttgagaattttaaagcaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgatttttttttttgcaccagtgaaacaataaagatgctattaacaattttggagctttttttcccctttcatactatctttaattgataaaaagaactagtagtatggctatagagtttaatagtcattctcatatattcacagagctcacttaactctagttttaagcacttgttgaacaaggcagcatctactcttttagtcatttataccccttttctttcctcaactttaccctgcttttcccaaggcatgatgaattcacataaaccccccaaaggctcaccactgatactagttacctactatataataaaccatcccaaaacttactgtcttaaaacagcaaacatttatctcacaggtctctggatcaggaatttgggagcagcttagctggtggttctggcaaagagtgtggtgtaaggttgcaaacaagatactggttggggctgcagtcatctgatgctttgactggggctgacttttctgctcactgacctggctgttaggcagaggccccagttcctcttcttgagggcagaggccccagttcctctccttgagggcagaggcctaagttcctttccttgagggcagaggccccagttcctctccttgacggcccttccatagagtgtcctcacagcatggtggctggctttcccctgagtatgaaagcaagaaggaaaccacagtgcctttcagtggcctccctgtggaagtgacatgctcatttttgccttattctgtaagtggggagtcactaagtctagcctatattcaagggtaaggagagttaagctccacctcttaaagggaaaatttatagacattttcaaatgactacatcacttaacccctcaccatctgccctcccattgctagcacttgatgactagcccttgctgggctttacatgaacagatgtttcccaaagttataaaattagtaccactaaaatgtatcaaatgttaagccattctgtggtatgtcatagtccagcaaaccctttctgttctttgtaggtgttagtttaccccgtataaacctgattatggcttgacatgtccatattatttacatgttttgtgaaatacaactggaatagtagaaaagacatgagtcaagaacacttgagttggagagcttggtttgcaagtaaggtaatgtcagtacagtgtgtaaattatctcttattttctgggttgaggtaaacccaattttaaaaataataaaccaacaaaagtaaataaaagtgaaacaaaagcactgctagtatccttaacttacagattttttttgttgaacaaaaactgggtaccagatatagttaggcactgaatctaaaggtgaagaagatcatagcctctagcttcaagaacgttagtctgctgtgaagacagacctgtagttacagaagatggtaagggtttgtgcaggagagcagtgaagaagagctttgagggattggggatggggaagttctgcagagggttgtatgaattctcatggaacatcaagtccaatagtttatttagccttctgaggccagtgctttggcctgcagtcccaggctcctcagacccatgggctgaagcaagttatactcttggctgcctgtagtgaaatagatatttagaaattgacttagcatttaaaaccctttatagcaatttgacagagtaattttatgtctattggatgtaataaatatttggctttgtttccatgtacatccagtgagggttttattacgctaggtttcccttccatagattgtgcctttcaaaaatgctgaggtaggtttcccatttcttacctgtgatgtgttttacccagcacctccgcacacataacattcaggaccttaataaaattattcacttggtaagtgttcaagtctttctgatcaccccaagtagcatgactgatctgcaatttaaaattcctgtgatctgtaaaaaaaaaa

SEQ ID NO: 361915 - DNA, 3215 bp, Homo sapiens
  misc_feature (2837)..(2837): n is a, c, g, or t
agcgtcacatgaccgcgggaggctacgcgcggggcgggtgctgcttgctgcaggctctggggagtcgccatgcctacaacacagcagtcccctcaggatgagcaggaaaagctcttggatgaagccatacaggctgtgaaggtccagtcattccaaatgaagagatgcctggacaaaaacaagcttatggatgctctaaaacatgcttctaatatgcttggtgaactccggacttctatgttatcaccaaagagttactatgaactttatatggccatttctgatgaactgcactacttggaggtctacctgacagatgagtttgctaaaggaaggaaagtggcagatctctacgaacttgtacagtatgctggaaacattatcccaaggctttaccttttgatcacagttggagttgtatatgtcaagtcatttcctcagtccaggaaggatattttgaaagatttggtagaaatgtgccgtggtgtgcaacatcccttgaggggtctgtttcttcgaaattaccttcttcagtgtaccagaaatatcttacctgatgaaggagagccaacagatgaagaaacaactggtgacatcagtgattccatggattttgtactgctcaactttgcagaaatgaacaagctctgggtgcgaatgcagcatcagggacatagccgagatagagaaaaaagagaacgagaaagacaagaactgagaattttagtgggaacaaatttggtgcgcctcagtcagttggaaggtgtaaatgtggaacgttacaaacagattgttttgactggcatattggagcaagttgtaaactgtagggatgctttggctcaagaatatctcatggagtgtattattcaggttttccctgatgaatttcacctccagactttgaatccttttcttcgggcctgtgctgagttacaccagaatgtaaatgtgaagaacataatcattgctttaattgatagattagctttatttgctcaccgtgaagatggacctggaatcccagcggatattaaactttttgatatattttcacagcaggtggctacagtgatacagtctagacaagacatgccttcagaggatgttgtatctttacaagtctctctgattaatcttgccatgaaatgttaccctgatcgtgtggactatgttgataaagttctagaaacaacagtggagatattcaataagctcaaccttgaacatattgctaccagtagtgcagtttcaaaggaactcaccagacttttgaaaataccagttgacacttacaacaatattttaacagtcttgaaattaaaacattttcacccactctttgagtactttgactacgagtccagaaagagcatgagttgttatgtgcttagtaatgttctggattataacacagaaattgtctctcaagaccaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggcattttctctgtatgaagatgaaatcagcgattccaaagcacagctagctgccatcaccttgatcattggcacttttgaaaggatgaagtgcttcagtgaagagaatcatgaacctctgaggactcagtgtgcccttgctgcatccaaacttctaaagaaacctgatcagggccgagctgtgagcacctgtgcacatctcttctggtctggcagaaacacggacaaaaatggggaggagcttcacggaggcaagagggtaatggagtgcctaaaaaaagctctaaaaatagcaaatcagtgcatggacccctctctacaagtgcagctttttatagaaattctgaacagatatatctatttttatgaaaaggaaaatgatgcggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatctgtaaaaaaaaaaaaaaaaaaaaaaaaaacaaaacccacttttttgggggccaaaaaggaacgcccccctttttagggcgggggaggggccccactgggtggatggggtattttctccacntccggggggagtattaccccaaaaggcgtttggtctcctggttatacaaggcagcagttggggacaatcaactttcgaacacagcacggcgactcccggggcgttggtagacactcccccttgtgggggtttccccccatagattgaggcaaagaataaggcgccccgttgttgtaaaaatttctccccttaaaagcgaaaaaattttttcagaacgggccctgtcgtgggacaaacacttttacaacggcgaccccaggggtgtacaacccaagacgcatattattttccggcaactaactggggcacactcaccgcatcttcattttaaaaaccccctgtgtgtggtctcgcgagaacatttttttccacattatg

SEQ ID NO: 361916 - DNA, 5125 bp, Homo sapiens
agcgtcacatgaccgcgggaggctacgcgcggggcgggtgctgcttgctgcaggctctggggagtcgccatgcctacaacacagcagtcccctcaggatgagcaggaaaagctcttggatgaagccatacaggctgtgaaggtccagtcattccaaatgaagagatgcctgacacaagcttatggatgctctgagttactatgaactttatatggccatttctgatgaactgcactacttggaggtctacctgacagatgagtttgctaaaggaaggaaagtggcagatctctacgaacttgtacagtatgctggaaacattatcccaaggctttaccttttgatcacagttggagttgtatatgtcaagtcatttcctcagtccaggaaggatattttgaaagatttggtagaaatgtgccgtggtgtgcaacatcccttgaggggtctgtttcttcgaaattaccttcttcagtgtaccagaaatatcttacctgatgaaggagagccaacagatgaagaaacaactggtgacatcagtgattccatggattttgtactgctcaactttgcagaaatgaacaagctctgggtgcgaatgcagcatcagggacatagccgagatagagaaaaaagagaacgagaaagacaagaactgagaattttagtgggaacaaatttggtgcgcctcagtcagttggaaggtgtaaatgtggaacgttacaaacagattgttttgactggcatattggagcaagttgtaaactgtagggatgctttggctcaagaatatctcatggagtgtattattcaggttttccctgatgaatttcacctccagactttgaatccttttcttcgggcctgtgctgagttacaccagaatgtaaatgtgaagaacataatcattgctttaattgatagattagctttatttgctcaccgtgaagatggacctggaatcccagcggatattaaactttttgatatattttcacagcaggtggctacagtgatacagtctagacaagacatgccttcagaggatgttgtatctttacaagtctctctgattaatcttgccatgaaatgttaccctgatcgtgtggactatgttgataaagttctagaaacaacagtggagatattcaataagctcaaccttgaacatattgctaccagtagtgcagtttcaaaggaactcaccagacttttgaaaataccagttgacacttacaacaatattttaacagtcttgaaattaaaacattttcacccactctttgagtactttgactacgagtccagaaagagcatgagttgttatgtgcttagtaatgttctggattataacacagaaattgtctctcaagaccaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggcattttctctgtatgaagatgaaatcagcgattccaaagcacagctagctgccatcaccttgatcattggcacttttgaaaggatgaagtgcttcagtgaagagaatcatgaacctctgaggactcagtgtgcccttgctgcatccaaacttctaaagaaacctgatcagggccgagctgtgagcacctgtgcacatctcttctggtctggcagaaacacggacaaaaatggggaggagcttcacggaggcaagagggtaatggagtgcctaaaaaaagctctaaaaatagcaaatcagtgcatggacccctctctacaagtgcagctttttatagaaattctgaacagatatatctatttttatgaaaaggaaaatgatgcggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatctgtaaaaaaaaaaaaaaaaaaaaaaaaaacaaaacccacaagcacttatcttggctactaatgaagctctccttttttttgtttgtttgtttgcttcattgttgattgtgtattttcttcattcctggggagtactaacccaaaagcgtctgtctcttgttttctagtccagtttgagattaatttagaagaaaggaatactgtatgtgaaattcatcttgggctttcccctaaattgcaagataaggccatgtgtaagattttccctaaaactagaatatattaatgcatgtttgagaattttaaagcaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgatttttttttttgcaccagtgaaacaataaagatgctattaacaattttggagctttttttcccctttcatactatctttaattgataaaaagaactagtagtatggctatagagtttaatagtcattctcatatattcacagagctcacttaactctagttttaagcacttgttgaacaaggcagcatctactcttttagtcatttataccccttttctttcctcaactttaccctgcttttcccaaggcatgatgaattcacataaaccccccaaaggctcaccactgatactagttacctactatataataaaccatcccaaaacttactgtcttaaaacagcaaacatttatctcacaggtctctggatcaggaatttgggagcagcttagctggtggttctggcaaagagtgtggtgtaaggttgcaaacaagatactggttggggctgcagtcatctgatgctttgactggggctgacttttctgctcactgacctggctgttaggcagaggccccagttcctcttcttgagggcagaggccccagttcctctccttgagggcagaggcctaagttcctttccttgagggcagaggccccagttcctctccttgacggcccttccatagagtgtcctcacagcatggtggctggctttcccctgagtatgaaagcaagaaggaaaccacagtgcctttcagtggcctccctgtggaagtgacatgctcatttttgccttattctgtaagtggggagtcactaagtctagcctatattcaagggtaaggagagttaagctccacctcttaaagggaaaatttatagacattttcaaatgactacatcacttaacccctcaccatctgccctcccattgctagcacttgatgactagcccttgctgggctttacatgaacagatgtttcccaaagttataaaattagtaccactaaaatgtatcaaatgttaagccattctgtggtatgtcatagtccagcaaaccctttctgttctttgtaggtgttagtttaccccgtataaacctgattatggcttgacatgtccatattatttacatgttttgtgaaatacaactggaatagtagaaaagacatgagtcaagaacacttgagttggagagcttggtttgcaagtaaggtaatgtcagtacagtgtgtaaattatctcttattttctgggttgaggtaaacccaattttaaaaataataaaccaacaaaagtaaataaaagtgaaacaaaagcactgctagtatccttaacttacagattttttttgttgaacaaaaactgggtaccagatatagttaggcactgaatctaaaggtgaagaagatcatagcctctagcttcaagaacgttagtctgctgtgaagacagacctgtagttacagaagatggtaagggtttgtgcaggagagcagtgaagaagagctttgagggattggggatggggaagttctgcagagggttgtatgaattctcatggaacatcaagtccaatagtttatttagccttctgaggccagtgctttggcctgcagtcccaggctcctcagacccatgggctgaagcaagttatactcttggctgcctgtagtgaaatagatatttagaaattgacttagcatttaaaaccctttatagcaatttgacagagtaattttatgtctattggatgtaataaatatttggctttgtttccatgtacatccagtgagggttttattacgctaggtttcccttccatagattgtgcctttcaaaaatgctgaggtaggtttcccatttcttacctgtgatgtgttttacccagcacctccgcacacataacattcaggaccttaataaaattattcacttggtaagtgttcaagtctttctgatcaccccaagtagcatgactgatctgcaatttaaaattcctgtgatctgtaaaaaaaaaa

SEQ ID NO: 361917 - DNA, 6821 bp, Homo sapiens
cccaaagtgctgggatacagatgtgagccaccacgcccagccacacaacatgtcttaaagtggattacttaatcttttgtgccacaactttttagcctttttagaaatacaaacgaaaaaaccactctcataagaagggccttactaggatttgtatttgtatgtttcagtgacttttgggctgttcacatgatcccctcacactaaaactttctttgatgccttcttacttcattgtgcccagactatgatgatgaaataattctcattttccatatccaaatagttacatagttataaagctaatgtgtatactaaaaagggctcacttgagaaaatcgatgttccttcaggcctcatactttagctcttctttctagctttcttcagtactttatcagatccctagttactgttctattcttaactcttctgctttatatcctgtgtgctattgtttttccgtcttgaatctttagtctttccctctcccaatccttcctttcaaccccactgtgctattctgcctgttcatcctaaaaagctttatctctgctctgcttccctcatggactatttgtcaaaatttatactctatcccataacttttaaattctgcctctataattcctttgcagtatctctaatataacttagtgacagttacaaagtataatttcctctgtatctttttttacgctcagtttgttgcagttcaccctgttgactgtgtccaactctttgtaactcttttctgcggagtggtatttcactcatagccttttcacctctcattgcttttttatcagtctctgcttcctctatgtatatccttaaatataaaagacagtctggcttaatggctgccttcttcagagtcagatttgctgtatttccaccacatagctattgtttaaccgtgcccaagttattttcctttttgaattttcgtttcagataggaaaagtggagatactttagacttattcctcaggagagtatatttgcattaatcctttcaactattatccctgtgaatttacatctgcatcttggattcttttctgaacacctaatacatgtctgtccttataccagacatttctacttttatgttgcaggcactcctcaaattgaaaatgtcagaaaatgaactcacatttccaaattttcctgtctactgtttaccttgtttcactttactttctctagaactagaaactcttggctgcaacttcaaagttacctttaactattggttttcttctgtgcctccacatccaataacttgccagttctctaccattctgtctcatggtcatttttatttttatggagacagtgtctgtgttgcgagactggtcttgaactcctggcctcaagcaattttcctgccttggcctcccaaagtgctgagattatgggcctaccaaatctctcaacttccttcatagtcctgtgctttaatgcactagaccatatactgttacccaaacataccatgcacttctatgcctctagtcctagctcatgttctttttttttctagcttaaaatacccctttataaattttaaacaaaattggtgtatatagttcttgctttttaaaatttcagcccataaacattttgtgattaactatccttctcatcttttaatacggtccctttcatgaagctttcctcaatctttcccagtgctcattcattgataattactcccttgtctgctctctttggtatattacttgcatcttcttttagtacttctgtgtgccttgcatttcatttagctatttgtggtttattttcaccattctacaactcttattttaatgtggtcgtagatgggaaatgtcttagagagttttgtttctctgaagggaagttgttagatctatgtcatatgttaaagtaaatggcattttagaattaagaaggggtgtatttcctcctgtgctagattgcataattcttgagtacgaggaccatgtttttttgtttttgtttttcaattccccatgtcttgtcttcattcttccctacgtcgtttttttttccttttcccactcttcatacattcatctaaccagtcacagactttctcagtagcaaaaagataattcagatgagatcaggcacgatcagggttgtatggccatagacaaaaagaatggaaattagcaacttttgaacagaattacagtgaaaatgctgcatatttaaacttgtggattagaacaaaaacatagcatagagaatatataggttttaatgattacattagaaaattaggctggaaatgaatgagttaagcatttatccagaaactctaaaaaaaagagagagaactgagaattttagtgggaacaaatttggtgcgcctcagtcagttggaaggtgtaaatgtggaacgttacaaacagattgttttgactggcatattggagcaagttgtaaactgtagggatgctttggctcaagaatatctcatggagtgtattattcaggttttccctgatgaatttcacctccagactttgaatccttttcttcgggcctgtgctgagttacaccagaatgtaaatgtgaagaacataatcattgctttaattgatagattagctttatttgctcaccgtgaagatggacctggaatcccagcggatattaaactttttgatatattttcacagcaggtggctacagtgatacagtctagacaagacatgccttcagaggatgttgtatctttacaagtctctctgattaatcttgccatgaaatgttaccctgatcgtgtggactatgttgataaagttctagaaacaacagtggagatattcaataagctcaaccttgaacatattgctaccagtagtgcagtttcaaaggaactcaccagacttttgaaaataccagttgacacttacaacaatattttaacagtcttgaaattaaaacattttcacccactctttgagtactttgactacgagtccagaaagagcatgagttgttatgtgcttagtaatgttctggattataacacagaaattgtctctcaagaccaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggcattttctctgtatgaagatgaaatcagcgattccaaagcacagctagctgccatcaccttgatcattggcacttttgaaaggatgaagtgcttcagtgaagagaatcatgaacctctgaggactcagtgtgcccttgctgcatccaaacttctaaagaaacctgatcagggccgagctgtgagcacctgtgcacatctcttctggtctggcagaaacacggacaaaaatggggaggagcttcacggaggcaagagggtaatggagtgcctaaaaaaagctctaaaaatagcaaatcagtgcatggacccctctctacaagtgcagctttttatagaaattctgaacagatatatctatttttatgaaaaggaaaatgatgcggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatctgtaaaaaaaaaaaaaaaaaaaaaaaaaacaaaacccacaagcacttatcttggctactaatgaagctctccttttttttgtttgtttgtttgcttcattgttgattgtgtattttcttcattcctggggagtactaacccaaaagcgtctgtctcttgttttctagtccagtttgagattaatttagaagaaaggaatactgtatgtgaaattcatcttgggctttcccctaaattgcaagataaggccatgtgtaagattttccctaaaactagaatatattaatgcatgtttgagaattttaaagcaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgatttttttttttgcaccagtgaaacaataaagatgctattaacaattttggagctttttttcccctttcatactatctttaattgataaaaagaactagtagtatggctatagagtttaatagtcattctcatatattcacagagctcacttaactctagttttaagcacttgttgaacaaggcagcatctactcttttagtcatttataccccttttctttcctcaactttaccctgcttttcccaaggcatgatgaattcacataaaccccccaaaggctcaccactgatactagttacctactatataataaaccatcccaaaacttactgtcttaaaacagcaaacatttatctcacaggtctctggatcaggaatttgggagcagcttagctggtggttctggcaaagagtgtggtgtaaggttgcaaacaagatactggttggggctgcagtcatctgatgctttgactggggctgacttttctgctcactgacctggctgttaggcagaggccccagttcctcttcttgagggcagaggccccagttcctctccttgagggcagaggcctaagttcctttccttgagggcagaggccccagttcctctccttgacggcccttccatagagtgtcctcacagcatggtggctggctttcccctgagtatgaaagcaagaaggaaaccacagtgcctttcagtggcctccctgtggaagtgacatgctcatttttgccttattctgtaagtggggagtcactaagtctagcctatattcaagggtaaggagagttaagctccacctcttaaagggaaaatttatagacattttcaaatgactacatcacttaacccctcaccatctgccctcccattgctagcacttgatgactagcccttgctgggctttacatgaacagatgtttcccaaagttataaaattagtaccactaaaatgtatcaaatgttaagccattctgtggtatgtcatagtccagcaaaccctttctgttctttgtaggtgttagtttaccccgtataaacctgattatggcttgacatgtccatattatttacatgttttgtgaaatacaactggaatagtagaaaagacatgagtcaagaacacttgagttggagagcttggtttgcaagtaaggtaatgtcagtacagtgtgtaaattatctcttattttctgggttgaggtaaacccaattttaaaaataataaaccaacaaaagtaaataaaagtgaaacaaaagcactgctagtatccttaacttacagattttttttgttgaacaaaaactgggtaccagatatagttaggcactgaatctaaaggtgaagaagatcatagcctctagcttcaagaacgttagtctgctgtgaagacagacctgtagttacagaagatggtaagggtttgtgcaggagagcagtgaagaagagctttgagggattggggatggggaagttctgcagagggttgtatgaattctcatggaacatcaagtccaatagtttatttagccttctgaggccagtgctttggcctgcagtcccaggctcctcagacccatgggctgaagcaagttatactcttggctgcctgtagtgaaatagatatttagaaattgacttagcatttaaaaccctttatagcaatttgacagagtaattttatgtctattggatgtaataaatatttggctttgtttccatgtacatccagtgagggttttattacgctaggtttcccttccatagattgtgcctttcaaaaatgctgaggtaggtttcccatttcttacctgtgatgtgttttacccagcacctccgcacacataacattcaggaccttaataaaattattcacttggtaagtgttcaagtctttctgatcaccccaagtagcatgactgatctgcaatttaaaattcctgtgatctgtaaaaaaaaaa

SEQ ID NO: 361918 - DNA, 4686 bp, Homo sapiens
gtggaacgtacctgtagtcccagcactcaggaggcttgaggtgggaggatgacttgagcctaggaggtggatgttgcattgagtggagattgtgccacttcactccagcctgggcaaccgaacaagaccttgtctcaaaaagaaaaaagcttttaaagtttagaagtgaagtcttggtgagaaaaatctcaaatacgattttcaagttagtagttcaaatgcgttactagaggaatagcttaagattttgaaaacagattttaacccttatgtgtgttttttctcttttagattgttttgactggcatattggagcaagttgtaaactgtagggatgctttggctcaagaatatctcatggagtgtattattcaggttttccctgatgaatttcacctccagactttgaatccttttcttcgggcctgtgctgagttacaccagaatgtaaatgtgaagaacataatcattgctttaattgatagattagctttatttgctcaccgtgaagatggacctggaatcccagcggatattaaactttttgatatattttcacagcaggtggctacagtgatacagtctagacaagacatgccttcagaggatgttgtatctttacaagtctctctgattaatcttgccatgaaatgttaccctgatcgtgtggactatgttgataaagttctagaaacaacagtggagatattcaataagctcaaccttgaacatattgctaccagtagtgcagtttcaaaggaactcaccagacttttgaaaataccagttgacacttacaacaatattttaacagtcttgaaattaaaacattttcacccactctttgagtactttgactacgagtccagaaagagcatgagttgttatgtgcttagtaatgttctggattataacacagaaattgtctctcaagaccaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggcattttctctgtatgaagatgaaatcagcgattccaaagcacagctagctgccatcaccttgatcattggcacttttgaaaggatgaagtgcttcagtgaagagaatcatgaacctctgaggactcagtgtgcccttgctgcatccaaacttctaaagaaacctgatcagggccgagctgtgagcacctgtgcacatctcttctggtctggcagaaacacggacaaaaatggggaggagcttcacggaggcaagagggtaatggagtgcctaaaaaaagctctaaaaatagcaaatcagtgcatggacccctctctacaagtgcagctttttatagaaattctgaacagatatatctatttttatgaaaaggaaaatgatgcggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatctgtaaaaaaaaaaaaaaaaaaaaaaaaaacaaaacccacaagcacttatcttggctactaatgaagctctccttttttttgtttgtttgtttgcttcattgttgattgtgtattttcttcattcctggggagtactaacccaaaagcgtctgtctcttgttttctagtccagtttgagattaatttagaagaaaggaatactgtatgtgaaattcatcttgggctttcccctaaattgcaagataaggccatgtgtaagattttccctaaaactagaatatattaatgcatgtttgagaattttaaagcaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgatttttttttttgcaccagtgaaacaataaagatgctattaacaattttggagctttttttcccctttcatactatctttaattgataaaaagaactagtagtatggctatagagtttaatagtcattctcatatattcacagagctcacttaactctagttttaagcacttgttgaacaaggcagcatctactcttttagtcatttataccccttttctttcctcaactttaccctgcttttcccaaggcatgatgaattcacataaaccccccaaaggctcaccactgatactagttacctactatataataaaccatcccaaaacttactgtcttaaaacagcaaacatttatctcacaggtctctggatcaggaatttgggagcagcttagctggtggttctggcaaagagtgtggtgtaaggttgcaaacaagatactggttggggctgcagtcatctgatgctttgactggggctgacttttctgctcactgacctggctgttaggcagaggccccagttcctcttcttgagggcagaggccccagttcctctccttgagggcagaggcctaagttcctttccttgagggcagaggccccagttcctctccttgacggcccttccatagagtgtcctcacagcatggtggctggctttcccctgagtatgaaagcaagaaggaaaccacagtgcctttcagtggcctccctgtggaagtgacatgctcatttttgccttattctgtaagtggggagtcactaagtctagcctatattcaagggtaaggagagttaagctccacctcttaaagggaaaatttatagacattttcaaatgactacatcacttaacccctcaccatctgccctcccattgctagcacttgatgactagcccttgctgggctttacatgaacagatgtttcccaaagttataaaattagtaccactaaaatgtatcaaatgttaagccattctgtggtatgtcatagtccagcaaaccctttctgttctttgtaggtgttagtttaccccgtataaacctgattatggcttgacatgtccatattatttacatgttttgtgaaatacaactggaatagtagaaaagacatgagtcaagaacacttgagttggagagcttggtttgcaagtaaggtaatgtcagtacagtgtgtaaattatctcttattttctgggttgaggtaaacccaattttaaaaataataaaccaacaaaagtaaataaaagtgaaacaaaagcactgctagtatccttaacttacagattttttttgttgaacaaaaactgggtaccagatatagttaggcactgaatctaaaggtgaagaagatcatagcctctagcttcaagaacgttagtctgctgtgaagacagacctgtagttacagaagatggtaagggtttgtgcaggagagcagtgaagaagagctttgagggattggggatggggaagttctgcagagggttgtatgaattctcatggaacatcaagtccaatagtttatttagccttctgaggccagtgctttggcctgcagtcccaggctcctcagacccatgggctgaagcaagttatactcttggctgcctgtagtgaaatagatatttagaaattgacttagcatttaaaaccctttatagcaatttgacagagtaattttatgtctattggatgtaataaatatttggctttgtttccatgtacatccagtgagggttttattacgctaggtttcccttccatagattgtgcctttcaaaaatgctgaggtaggtttcccatttcttacctgtgatgtgttttacccagcacctccgcacacataacattcaggaccttaataaaattattcacttggtaagtgttcaagtctttctgatcaccccaagtagcatgactgatctgcaatttaaaattcctgtgatctgtaaaaaaaaaa

SEQ ID NO: 361919 - DNA, 2650 bp, Homo sapiens
agcgtcacatgaccgcgggaggctacgcgcggggcgggtgctgcttgctgcaggctctggggagtcgccatgcctacaacacagcagtcccctcaggatgagcaggaaaagctcttggatgaagccatacaggctgtgaaggtccagtcattccaaatgaagagatgcctggacaaaaacaagcttatggatgctctaaaacatgcttctaatatgcttggtgaactccggacttctatgttatcaccaaagagttactatgaactttatatggccatttctgatgaactgcactacttggaggtctacctgacagatgagtttgctaaaggaaggaaagtggcagatctctacgaacttgtacagtatgctggaaacattatcccaaggctttaccttttgatcacagttggagttgtatatgtcaagtcatttcctcagtccaggaaggatattttgaaagatttggtagaaatgtgccgtggtgtgcaacatcccttgaggggtctgtttcttcgaaattaccttcttcagtgtaccagaaatatcttacctgatgaaggagagccaacagatgaagaaacaactggtgacatcagtgattccatggattttgtactgctcaactttgcagaaatgaacaagctctgggtgcgaatgcagcatcagggacatagccgagatagagaaaaaagagaacgagaaagacaagaactgagaattttagtgggaacaaatttggtgcgcctcagtcagttggaaggtgtaaatgtggaacgttacaaacagattgttttgactggcatattggagcaagttgtaaactgtagggatgctttggctcaagaatatctcatggagtgtattattcaggttttccctgatgaatttcacctccagactttgaatccttttcttcgggcctgtgctgagttacaccagaatgtaaatgtgaagaacataatcattgctttaattgatagattagctttatttgctcaccgtgaagatggacctggaatcccagcggatattaaactttttgatatattttcacagcaggtggctacagtgatacagtctagacaagacatgccttcagaggatgttgtatctttacaagtctctctgattaatcttgccatgaaatgttaccctgatcgtgtggactatgttgataaagttctagaaacaacagtggagatattcaataagctcaaccttgaacatattgctaccagtagtgcagtttcaaaggaactcaccagacttttgaaaataccagttgacacttacaacaatattttaacagtcttgaaattaaaacattttcacccactctttgagtactttgactacgagtccagaaagagcatgagttgttatgtgcttagtaatgttctggattataacacagaaattgtctctcaagaccaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggcattttctctgtatgaagatgaaatcagcgattccaaagcacagctagctgccatcaccttgatcattggcacttttgaaaggatgaagtgcttcagtgaagagaatcatgaacctctgaggactcagtgtgcccttgctgcatccaaacttctaaagaaacctgatcagggccgagctgtgagcacctgtgcacatctcttctggtctggcagaaacacggacaaaaatggggaggagcttcacggaggcaagagggtaatggagtgcctaaaaaaagctctaaaaatagcaaatcagtgcatggacccctctctacaagtgcagctttttatagaaattctgaacagatatatctatttttatgaaaaggaaaatgatgcggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggta

SEQ ID NO: 361920 - DNA, 3753 bp, Homo sapiens
gacaacttgaggagataagaaatatgtaaattgcctaccataaagtatggtacattgtatatattcacaaaatgttagcaatgatgattagagcccacatttatttcacaaatgattaatcagagtttggaaatttttttttctttaatgcttttgggtcagattttgaacacagcacgaaaacattttggagctggtggaaatcagcggattcgcttcacactgccacctttggtatttgcagcttaccagctggcttttcgatataaagagaattctaaagtggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggcattttctctgtatgaagatgaaatcagcgattccaaagcacagctagctgccatcaccttgatcattggcacttttgaaaggatgaagtgcttcagtgaagagaatcatgaacctctgaggactcagtgtgcccttgctgcatccaaacttctaaagaaacctgatcagggccgagctgtgagcacctgtgcacatctcttctggtctggcagaaacacggacaaaaatggggaggagcttcacggaggcaagagggtaatggagtgcctaaaaaaagctctaaaaatagcaaatcagtgcatggacccctctctacaagtgcagctttttatagaaattctgaacagatatatctatttttatgaaaaggaaaatgatgcggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatctgtaaaaaaaaaaaaaaaaaaaaaaaaaacaaaacccacaagcacttatcttggctactaatgaagctctccttttttttgtttgtttgtttgcttcattgttgattgtgtattttcttcattcctggggagtactaacccaaaagcgtctgtctcttgttttctagtccagtttgagattaatttagaagaaaggaatactgtatgtgaaattcatcttgggctttcccctaaattgcaagataaggccatgtgtaagattttccctaaaactagaatatattaatgcatgtttgagaattttaaagcaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgatttttttttttgcaccagtgaaacaataaagatgctattaacaattttggagctttttttcccctttcatactatctttaattgataaaaagaactagtagtatggctatagagtttaatagtcattctcatatattcacagagctcacttaactctagttttaagcacttgttgaacaaggcagcatctactcttttagtcatttataccccttttctttcctcaactttaccctgcttttcccaaggcatgatgaattcacataaaccccccaaaggctcaccactgatactagttacctactatataataaaccatcccaaaacttactgtcttaaaacagcaaacatttatctcacaggtctctggatcaggaatttgggagcagcttagctggtggttctggcaaagagtgtggtgtaaggttgcaaacaagatactggttggggctgcagtcatctgatgctttgactggggctgacttttctgctcactgacctggctgttaggcagaggccccagttcctcttcttgagggcagaggccccagttcctctccttgagggcagaggcctaagttcctttccttgagggcagaggccccagttcctctccttgacggcccttccatagagtgtcctcacagcatggtggctggctttcccctgagtatgaaagcaagaaggaaaccacagtgcctttcagtggcctccctgtggaagtgacatgctcatttttgccttattctgtaagtggggagtcactaagtctagcctatattcaagggtaaggagagttaagctccacctcttaaagggaaaatttatagacattttcaaatgactacatcacttaacccctcaccatctgccctcccattgctagcacttgatgactagcccttgctgggctttacatgaacagatgtttcccaaagttataaaattagtaccactaaaatgtatcaaatgttaagccattctgtggtatgtcatagtccagcaaaccctttctgttctttgtaggtgttagtttaccccgtataaacctgattatggcttgacatgtccatattatttacatgttttgtgaaatacaactggaatagtagaaaagacatgagtcaagaacacttgagttggagagcttggtttgcaagtaaggtaatgtcagtacagtgtgtaaattatctcttattttctgggttgaggtaaacccaattttaaaaataataaaccaacaaaagtaaataaaagtgaaacaaaagcactgctagtatccttaacttacagattttttttgttgaacaaaaactgggtaccagatatagttaggcactgaatctaaaggtgaagaagatcatagcctctagcttcaagaacgttagtctgctgtgaagacagacctgtagttacagaagatggtaagggtttgtgcaggagagcagtgaagaagagctttgagggattggggatggggaagttctgcagagggttgtatgaattctcatggaacatcaagtccaatagtttatttagccttctgaggccagtgctttggcctgcagtcccaggctcctcagacccatgggctgaagcaagttatactcttggctgcctgtagtgaaatagatatttagaaattgacttagcatttaaaaccctttatagcaatttgacagagtaattttatgtctattggatgtaataaatatttggctttgtttccatgtacatccagtgagggttttattacgctaggtttcccttccatagattgtgcctttcaaaaatgctgaggtaggtttcccatttcttacctgtgatgtgttttacccagcacctccgcacacataacattcaggaccttaataaaattattcacttggtaagtgttcaagtctttctgatcaccccaagtagcatgactgatctgcaatttaaaattcctgtgatctgtaaaaaaaaaa

SEQ ID NO: 361921 - DNA, 1746 bp, Homo sapiens
  misc_feature (1736)..(1736): n is a, c, g, or t
agcgtcacatgaccgcgggaggctacgcgcggggcgggtgctgcttgctgcaggctctggggagtcgccatgcctacaacacagcagtcccctcaggatgagcaggaaaagctcttggatgaagccatacaggctgtgaaggtccagtcattccaaatgaagagatgcctggacaaaaacaagcttatggatgctctaaaacatgcttctaatatgcttggtgaactccggacttctatgttatcaccaaagagttactatgaactttatatggccatttctgatgaactgcactacttggaggtctacctgacagatgagtttgctaaaggaaggaaagtggcagatctctacgaacttgtacagtatgctggaaacattatcccaaggctttaccttttgatcacagttggagttgtatatgtcaagtcatttcctcagtccaggaaggatattttgaaagatttggtagaaatgtgccgtggtgtgcaacatcccttgaggggtctgtttcttcgaaattaccttcttcagtgtaccagaaatatcttacctgatgaaggagagccaacagatgaagaaacaactggtgacatcagtgattccatggattttgtactgctcaactttgcagaaatgaacaagctctgggtgcgaatgcagcatcagggacatagccgagatagagaaaaaagagaacgagaaagacaagaactgagaattttagtgggaacaaatttggtgcgcctcagtcagttggaaggtgtaaatgtggaacgttacaaacagattgttttgactggcatattggagcaagttgtaaactgtagggatgctttggctcaagaatatctcatggagtgtattattcaggttttccctgatgaatttcacctccagactttgaatccttttcttcgggcctgtgctgagttacaccagaatgtaaatgtgaagaacataatcattgctttaattgatagattagctttatttgctcaccgtgaagatggacctggaatcccagcggatattaaactttttgatatattttcacagcaggtggctacagtgatacagtctagacaagacatgccttcagaggatgttgtatctttacaagtctctctgattaatcttgccatgaaatgttaccctgatcgtgtggactatgttgataaagttctagaaacaacagtggagatattcaataagctcaaccttgaacatattgctaccagtagtgcagtttcaaaggaactcaccagacttttgaaaataccagttgacacttacaacaatattttaacagtcttgaaattaaaacattttcacccactctttgagtactttgactacgagtccagaaagagcatgagttgttatgtgcttagtaatgttctggattataacacagaaattgtctctcaagaccaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggatcatttcggggggggatnctctaggaga

SEQ ID NO: 361922 - DNA, 3157 bp, Homo sapiens
cacctagtttatgcagtttgtgtttctgccagtaccagatagagatgtgcacaggtgctcacagctcggccctgtatcaggcagaaacacggacaaaaatggggaggagcttcacggaggcaagagggtaatggagtgcctaaaaaaagctctaaaaatagcaaatcagtgcatggacccctctctacaagtgcagctttttatagaaattctgaacagatatatctatttttatgaaaaggaaaatgatgcggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatctgtaaaaaaaaaaaaaaaaaaaaaaaaaacaaaacccacaagcacttatcttggctactaatgaagctctccttttttttgtttgtttgtttgcttcattgttgattgtgtattttcttcattcctggggagtactaacccaaaagcgtctgtctcttgttttctagtccagtttgagattaatttagaagaaaggaatactgtatgtgaaattcatcttgggctttcccctaaattgcaagataaggccatgtgtaagattttccctaaaactagaatatattaatgcatgtttgagaattttaaagcaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgatttttttttttgcaccagtgaaacaataaagatgctattaacaattttggagctttttttcccctttcatactatctttaattgataaaaagaactagtagtatggctatagagtttaatagtcattctcatatattcacagagctcacttaactctagttttaagcacttgttgaacaaggcagcatctactcttttagtcatttataccccttttctttcctcaactttaccctgcttttcccaaggcatgatgaattcacataaaccccccaaaggctcaccactgatactagttacctactatataataaaccatcccaaaacttactgtcttaaaacagcaaacatttatctcacaggtctctggatcaggaatttgggagcagcttagctggtggttctggcaaagagtgtggtgtaaggttgcaaacaagatactggttggggctgcagtcatctgatgctttgactggggctgacttttctgctcactgacctggctgttaggcagaggccccagttcctcttcttgagggcagaggccccagttcctctccttgagggcagaggcctaagttcctttccttgagggcagaggccccagttcctctccttgacggcccttccatagagtgtcctcacagcatggtggctggctttcccctgagtatgaaagcaagaaggaaaccacagtgcctttcagtggcctccctgtggaagtgacatgctcatttttgccttattctgtaagtggggagtcactaagtctagcctatattcaagggtaaggagagttaagctccacctcttaaagggaaaatttatagacattttcaaatgactacatcacttaacccctcaccatctgccctcccattgctagcacttgatgactagcccttgctgggctttacatgaacagatgtttcccaaagttataaaattagtaccactaaaatgtatcaaatgttaagccattctgtggtatgtcatagtccagcaaaccctttctgttctttgtaggtgttagtttaccccgtataaacctgattatggcttgacatgtccatattatttacatgttttgtgaaatacaactggaatagtagaaaagacatgagtcaagaacacttgagttggagagcttggtttgcaagtaaggtaatgtcagtacagtgtgtaaattatctcttattttctgggttgaggtaaacccaattttaaaaataataaaccaacaaaagtaaataaaagtgaaacaaaagcactgctagtatccttaacttacagattttttttgttgaacaaaaactgggtaccagatatagttaggcactgaatctaaaggtgaagaagatcatagcctctagcttcaagaacgttagtctgctgtgaagacagacctgtagttacagaagatggtaagggtttgtgcaggagagcagtgaagaagagctttgagggattggggatggggaagttctgcagagggttgtatgaattctcatggaacatcaagtccaatagtttatttagccttctgaggccagtgctttggcctgcagtcccaggctcctcagacccatgggctgaagcaagttatactcttggctgcctgtagtgaaatagatatttagaaattgacttagcatttaaaaccctttatagcaatttgacagagtaattttatgtctattggatgtaataaatatttggctttgtttccatgtacatccagtgagggttttattacgctaggtttcccttccatagattgtgcctttcaaaaatgctgaggtaggtttcccatttcttacctgtgatgtgttttacccagcacctccgcacacataacattcaggaccttaataaaattattcacttggtaagtgttcaagtctttctgatcaccccaagtagcatgactgatctgcaatttaaaattcctgtgatctgtaaaaaaaaaa

SEQ ID NO: 361923 - DNA, 2559 bp, Homo sapiens
ggggtcccccggggggtggggggggggcgcccccgccgcgcccccgggagcccccgcccccccccaaaaaaaaaaaaaaaaaaaaaaaaaaaaaaaaaaaaaaaaaaaaaaaaaaaaaaacaaaacccacaagcacttatcttggctactaatgaagctctccttttttttgtttgtttgtttgcttcattgttgattgtgtattttcttcattcctggggagtactaacccaaaagcgtctgtctcttgttttctagtccagtttgagattaatttagaagaaaggaatactgtatgtgaaattcatcttgggctttcccctaaattgcaagataaggccatgtgtaagattttccctaaaactagaatatattaatgcatgtttgagaattttaaagcaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgatttttttttttgcaccagtgaaacaataaagatgctattaacaattttggagctttttttcccctttcatactatctttaattgataaaaagaactagtagtatggctatagagtttaatagtcattctcatatattcacagagctcacttaactctagttttaagcacttgttgaacaaggcagcatctactcttttagtcatttataccccttttctttcctcaactttaccctgcttttcccaaggcatgatgaattcacataaaccccccaaaggctcaccactgatactagttacctactatataataaaccatcccaaaacttactgtcttaaaacagcaaacatttatctcacaggtctctggatcaggaatttgggagcagcttagctggtggttctggcaaagagtgtggtgtaaggttgcaaacaagatactggttggggctgcagtcatctgatgctttgactggggctgacttttctgctcactgacctggctgttaggcagaggccccagttcctcttcttgagggcagaggccccagttcctctccttgagggcagaggcctaagttcctttccttgagggcagaggccccagttcctctccttgacggcccttccatagagtgtcctcacagcatggtggctggctttcccctgagtatgaaagcaagaaggaaaccacagtgcctttcagtggcctccctgtggaagtgacatgctcatttttgccttattctgtaagtggggagtcactaagtctagcctatattcaagggtaaggagagttaagctccacctcttaaagggaaaatttatagacattttcaaatgactacatcacttaacccctcaccatctgccctcccattgctagcacttgatgactagcccttgctgggctttacatgaacagatgtttcccaaagttataaaattagtaccactaaaatgtatcaaatgttaagccattctgtggtatgtcatagtccagcaaaccctttctgttctttgtaggtgttagtttaccccgtataaacctgattatggcttgacatgtccatattatttacatgttttgtgaaatacaactggaatagtagaaaagacatgagtcaagaacacttgagttggagagcttggtttgcaagtaaggtaatgtcagtacagtgtgtaaattatctcttattttctgggttgaggtaaacccaattttaaaaataataaaccaacaaaagtaaataaaagtgaaacaaaagcactgctagtatccttaacttacagattttttttgttgaacaaaaactgggtaccagatatagttaggcactgaatctaaaggtgaagaagatcatagcctctagcttcaagaacgttagtctgctgtgaagacagacctgtagttacagaagatggtaagggtttgtgcaggagagcagtgaagaagagctttgagggattggggatggggaagttctgcagagggttgtatgaattctcatggaacatcaagtccaatagtttatttagccttctgaggccagtgctttggcctgcagtcccaggctcctcagacccatgggctgaagcaagttatactcttggctgcctgtagtgaaatagatatttagaaattgacttagcatttaaaaccctttatagcaatttgacagagtaattttatgtctattggatgtaataaatatttggctttgtttccatgtacatccagtgagggttttattacgctaggtttcccttccatagattgtgcctttcaaaaatgctgaggtaggtttcccatttcttacctgtgatgtgttttacccagcacctccgcacacataacattcaggaccttaataaaattattcacttggtaagtgttcaagtctttctgatcaccccaagtagcatgactgatctgcaatttaaaattcctgtgatctgtaaaaaaaaaa

SEQ ID NO: 361924 - DNA, 2234 bp, Homo sapiens
ttgctccctggggactctaaaactaggtgctattgaaacttctaaaactcctagtttttagaagtttccatagccaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgatttttttttttgcaccagtgaaacaataaagatgctattaacaattttggagctttttttcccctttcatactatctttaattgataaaaagaactagtagtatggctatagagtttaatagtcattctcatatattcacagagctcacttaactctagttttaagcacttgttgaacaaggcagcatctactcttttagtcatttataccccttttctttcctcaactttaccctgcttttcccaaggcatgatgaattcacataaaccccccaaaggctcaccactgatactagttacctactatataataaaccatcccaaaacttactgtcttaaaacagcaaacatttatctcacaggtctctggatcaggaatttgggagcagcttagctggtggttctggcaaagagtgtggtgtaaggttgcaaacaagatactggttggggctgcagtcatctgatgctttgactggggctgacttttctgctcactgacctggctgttaggcagaggccccagttcctcttcttgagggcagaggccccagttcctctccttgagggcagaggcctaagttcctttccttgagggcagaggccccagttcctctccttgacggcccttccatagagtgtcctcacagcatggtggctggctttcccctgagtatgaaagcaagaaggaaaccacagtgcctttcagtggcctccctgtggaagtgacatgctcatttttgccttattctgtaagtggggagtcactaagtctagcctatattcaagggtaaggagagttaagctccacctcttaaagggaaaatttatagacattttcaaatgactacatcacttaacccctcaccatctgccctcccattgctagcacttgatgactagcccttgctgggctttacatgaacagatgtttcccaaagttataaaattagtaccactaaaatgtatcaaatgttaagccattctgtggtatgtcatagtccagcaaaccctttctgttctttgtaggtgttagtttaccccgtataaacctgattatggcttgacatgtccatattatttacatgttttgtgaaatacaactggaatagtagaaaagacatgagtcaagaacacttgagttggagagcttggtttgcaagtaaggtaatgtcagtacagtgtgtaaattatctcttattttctgggttgaggtaaacccaattttaaaaataataaaccaacaaaagtaaataaaagtgaaacaaaagcactgctagtatccttaacttacagattttttttgttgaacaaaaactgggtaccagatatagttaggcactgaatctaaaggtgaagaagatcatagcctctagcttcaagaacgttagtctgctgtgaagacagacctgtagttacagaagatggtaagggtttgtgcaggagagcagtgaagaagagctttgagggattggggatggggaagttctgcagagggttgtatgaattctcatggaacatcaagtccaatagtttatttagccttctgaggccagtgctttggcctgcagtcccaggctcctcagacccatgggctgaagcaagttatactcttggctgcctgtagtgaaatagatatttagaaattgacttagcatttaaaaccctttatagcaatttgacagagtaattttatgtctattggatgtaataaatatttggctttgtttccatgtacatccagtgagggttttattacgctaggtttcccttccatagattgtgcctttcaaaaatgctgaggtaggtttcccatttcttacctgtgatgtgttttacccagcacctccgcacacataacattcaggaccttaataaaattattcacttggtaagtgttcaagtctttctgatcaccccaagtagcatgactgatctgcaatttaaaattcctgtgatctgtaaaaaaaaaa

SEQ ID NO: 361925 - DNA, 2041 bp, Homo sapiens
cagccccaaccagtatcttgtttgcaacctcacaccacactctttgccagaaccaccagctaagctgctcccaaattcctgatccagagacctgtgagataaatgtttgctgttttaagacagtaagttttgggatggtttattatatagtaggtcactagtatcagtggtgagcctttggggagtttaatagtcattctcatatattcacagagctcacttaactctagttttaagcacttgttgaacaaggcagcatctactcttttagtcatttataccccttttctttcctcaactttaccctgcttttcccaaggcatgatgaattcacataaaccccccaaaggctcaccactgatactagttacctactatataataaaccatcccaaaacttactgtcttaaaacagcaaacatttatctcacaggtctctggatcaggaatttgggagcagcttagctggtggttctggcaaagagtgtggtgtaaggttgcaaacaagatactggttggggctgcagtcatctgatgctttgactggggctgacttttctgctcactgacctggctgttaggcagaggccccagttcctcttcttgagggcagaggccccagttcctctccttgagggcagaggcctaagttcctttccttgagggcagaggccccagttcctctccttgacggcccttccatagagtgtcctcacagcatggtggctggctttcccctgagtatgaaagcaagaaggaaaccacagtgcctttcagtggcctccctgtggaagtgacatgctcatttttgccttattctgtaagtggggagtcactaagtctagcctatattcaagggtaaggagagttaagctccacctcttaaagggaaaatttatagacattttcaaatgactacatcacttaacccctcaccatctgccctcccattgctagcacttgatgactagcccttgctgggctttacatgaacagatgtttcccaaagttataaaattagtaccactaaaatgtatcaaatgttaagccattctgtggtatgtcatagtccagcaaaccctttctgttctttgtaggtgttagtttaccccgtataaacctgattatggcttgacatgtccatattatttacatgttttgtgaaatacaactggaatagtagaaaagacatgagtcaagaacacttgagttggagagcttggtttgcaagtaaggtaatgtcagtacagtgtgtaaattatctcttattttctgggttgaggtaaacccaattttaaaaataataaaccaacaaaagtaaataaaagtgaaacaaaagcactgctagtatccttaacttacagattttttttgttgaacaaaaactgggtaccagatatagttaggcactgaatctaaaggtgaagaagatcatagcctctagcttcaagaacgttagtctgctgtgaagacagacctgtagttacagaagatggtaagggtttgtgcaggagagcagtgaagaagagctttgagggattggggatggggaagttctgcagagggttgtatgaattctcatggaacatcaagtccaatagtttatttagccttctgaggccagtgctttggcctgcagtcccaggctcctcagacccatgggctgaagcaagttatactcttggctgcctgtagtgaaatagatatttagaaattgacttagcatttaaaaccctttatagcaatttgacagagtaattttatgtctattggatgtaataaatatttggctttgtttccatgtacatccagtgagggttttattacgctaggtttcccttccatagattgtgcctttcaaaaatgctgaggtaggtttcccatttcttacctgtgatgtgttttacccagcacctccgcacacataacattcaggaccttaataaaattattcacttggtaagtgttcaagtctttctgatcaccccaagtagcatgactgatctgcaatttaaaattcctgtgatctgtaaaaaaaaaa

SEQ ID NO: 361926 - DNA, 5184 bp, Homo sapiens
agcgtcacatgaccgcgggaggctacgcgcggggcgggtgctgcttgctgcaggctctggggagtcgccatgcctacaacacagcagtcccctcaggatgagcaggaaaagctcttggatgaagccatacaggctgtgaaggtccagtcattccaaatgaagagatgcctggacaaaaacaagcttatggatgctctaaaacatgcttctaatatgcttggtgaactccggacttctatgttatcaccaaagagttactatgaactttatatggccatttctgatgaactgcactacttggaggtctacctgacagatgagtttgctaaaggaaggaaagtggcagatctctacgaacttgtacagtatgctggaaacattatcccaaggctttaccttttgatcacagttggagttgtatatgtcaagtcatttcctcagtccaggaaggatattttgaaagatttggtagaaatgtgccgtggtgtgcaacatcccttgaggggtctgtttcttcgaaattaccttcttcagtgtaccagaaatatcttacctgatgaaggagagccaacagatgaagaaacaactggtgacatcagtgattccatggattttgtactgctcaactttgcagaaatgaacaagctctgggtgcgaatgcagcatcagggacatagccgagatagagaaaaaagagaacgagaaagacaagaactgagaattttagtgggaacaaatttggtgcgcctcagtcagttggaaggtgtaaatgtggaacgttacaaacagattgttttgactggcatattggagcaagttgtaaactgtagggatgctttggctcaagaatatctcatggagtgtattattcaggttttccctgatgaatttcacctccagactttgaatccttttcttcgggcctgtgctgagttacaccagaatgtaaatgtgaagaacataatcattgctttaattgatagattagctttatttgctcaccgtgaagatggacctggaatcccagcggatattaaactttttgatatattttcacagcaggtggctacagtgatacagtctagacaagacatgccttcagaggatgttgtatctttacaagtctctctgattaatcttgccatgaaatgttaccctgatcgtgtggactatgttgataaagttctagaaacaacagtggagatattcaataagctcaaccttgaacatattgctaccagtagtgcagtttcaaaggaactcaccagacttttgaaaataccagttgacacttacaacaatattttaacagtcttgaaattaaaacattttcacccactctttgagtactttgactacgagtccagaaagagcatgagttgttatgtgcttagtaatgttctggattataacacagaaattgtctctcaagaccaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggcattttctctgtatgaagatgaaatcagcgattccaaagcacagctagctgccatcaccttgatcattggcacttttgaaaggatgaagtgcttcagtgaagagaatcatgaacctctgaggactcagtgtgcccttgctgcatccaaacttctaaagaaacctgatcagggccgagctgtgagcacctgtgcacatctcttctggtctggcagaaacacggacaaaaatggggaggagcttcacggaggcaagagggtaatggagtgcctaaaaaaagctctaaaaatagcaaatcagtgcatggacccctctctacaagtgcagctttttatagaaattctgaacagatatatctatttttatgaaaaggaaaatgatgcggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatctgtaaaaaaaaaaaaaaaaaaaaaaaaaacaaaacccacaagcacttatcttggctactaatgaagctctccttttttttgtttgtttgtttgcttcattgttgattgtgtattttcttcattcctggggagtactaacccaaaagcgtctgtctcttgttttctagtccagtttgagattaatttagaagaaaggaatactgtatgtgaaattcatcttgggctttcccctaaattgcaagataaggccatgtgtaagattttccctaaaactagaatatattaatgcatgtttgagaattttaaagcaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgatttttttttttgcaccagtgaaacaataaagatgctattaacaattttggagctttttttcccctttcatactatctttaattgataaaaagaactagtagtatggctatagagtttaatagtcattctcatatattcacagagctcacttaactctagttttaagcacttgttgaacaaggcagcatctactcttttagtcatttataccccttttctttcctcaactttaccctgcttttcccaaggcatgatgaattcacataaaccccccaaaggctcaccactgatactagttacctactatataataaaccatcccaaaacttactgtcttaaaacagcaaacatttatctcacaggtctctggatcaggaatttgggagcagcttagctggtggttctggcaaagagtgtggtgtaaggttgcaaacaagatactggttggggctgcagtcatctgatgctttgactggggctgacttttctgctcactgacctggctgttaggcagaggccccagttcctcttcttgagggcagaggccccagttcctctccttgagggcagaggcctaagttcctttccttgagggcagaggccccagttcctctccttgacggcccttccatagagtgtcctcacagcatggtggctggctttcccctgagtatgaaagcaagaaggaaaccacagtgcctttcagtggcctccctgtggaagtgacatgctcatttttgccttattctgtaagtggggagtcactaagtctagcctatattcaagggtaaggagagttaagctccacctcttaaagggaaaatttatagacattttcaaatgactacatcacttaacccctcaccatctgccctcccattgctagcacttgatgactagcccttgctgggctttacatgaacagatgtttcccaaagttataaaattagtaccactaaaatgtatcaaatgttaagccattctgtggtatgtcatagtccagcaaaccctttctgttctttgtaggtgttagtttaccccgtataaacctgattatggcttgacatgtccatattatttacatgttttgtgaaatacaactggaatagtagaaaagacatgagtcaagaacacttgagttggagagcttggtttgcaagtaaggtaatgtcagtacagtgtgtaaattatctcttattttctgggttgaggtaaacccaattttaaaaataataaaccaacaaaagtaaataaaagtgaaacaaaagcactgctagtatccttaacttacagattttttttgttgaacaaaaactgggtaccagatatagttaggcactgaatctaaaggtgaagaagatcatagcctctagcttcaagaacgttagtctgctgtgaagacagacctgtagttacagaagatggtaagggtttgtgcaggagagcagtgaagaagagctttgagggattggggatggggaagttctgcagagggttgtatgaattctcatggaacatcaagtccaatagtttatttagccttctgaggccagtgctttggcctgcagtcccaggctcctcagacccatgggctgaagcaagttatactcttggctgcctgtagtgaaatagatatttagaaattgacttagcatttaaaaccctttatagcaatttgacagagtaattttatgtctattggatgtaataaatatttggctttgtttccatgtacatccagtgagggttttattacgctaggtttcccttccatagattgtgcctttcaaaaatgctgaggtaggtttcccatttcttacctgtgatgtgttttacccagcacctccgcacacataacattcaggaccttaataaaattattcacttggtaagtgttcaagtctttctgatcaccccaagtagcatgactgatctgcaatttaaaattcctgtgatctgtaaaaaaaaaa

SEQ ID NO: 361927 - DNA, 3303 bp, Homo sapiens
  misc_feature (3285)..(3285): n is a, c, g, or t
agcgtcacatgaccgcgggaggctacgcgcggggcgggtgctgcttgctgcaggctctggggagtcgccatgcctacaacacagcagtcccctcaggatgagcaggaaaagctcttggatgaagccatacaggctgtgaaggtccagtcattccaaatgaagagatgcctggacaaaaacaagcttatggatgctctaaaacatgcttctaatatgcttggtgaactccggacttctatgttatcaccaaagagttactatgaactttatatggccatttctgatgaactgcactacttggaggtctacctgacagatgagtttgctaaaggaaggaaagtggcagatctctacgaacttgtacagtatgctggaaacattatcccaaggctttaccttttgatcacagttggagttgtatatgtcaagtcatttcctcagtccaggaaggatattttgaaagatttggtagaaatgtgccgtggtgtgcaacatcccttgaggggtctgtttcttcgaaattaccttcttcagtgtaccagaaatatcttacctgatgaaggagagccaacagatgaagaaacaactggtgacatcagtgattccatggattttgtactgctcaactttgcagaaatgaacaagctctgggtgcgaatgcagcatcagggacatagccgagatagagaaaaaagagaacgagaaagacaagaactgagaattttagtgggaacaaatttggtgcgcctcagtcagttggaaggtgtaaatgtggaacgttacaaacagattgttttgactggcatattggagcaagttgtaaactgtagggatgctttggctcaagaatatctcatggagtgtattattcaggttttccctgatgaatttcacctccagactttgaatccttttcttcgggcctgtgctgagttacaccagaatgtaaatgtgaagaacataatcattgctttaattgatagattagctttatttgctcaccgtgaagatggacctggaatcccagcggatattaaactttttgatatattttcacagcaggtggctacagtgatacagtctagacaagacatgccttcagaggatgttgtatctttacaagtctctctgattaatcttgccatgaaatgttaccctgatcgtgtggactatgttgataaagttctagaaacaacagtggagatattcaataagctcaaccttgaacatattgctaccagtagtgcagtttcaaaggaactcaccagacttttgaaaataccagttgacacttacaacaatattttaacagtcttgaaattaaaacattttcacccactctttgagtactttgactacgagtccagaaagagcatgagttgttatgtgcttagtaatgttctggattataacacagaaattgtctctcaagaccaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggcattttctctgtatgaagatgaaatcagcgattccaaagcacagctagctgccatcaccttgatcattggcacttttgaaaggatgaagtgcttcagtgaagagaatcatgaacctctgaggactcagtgtgcccttgctgcatccaaacttctaaagaaacctgatcagggccgagctgtgagcacctgtgcacatctcttctggtctggcagaaacacggacaaaaatggggaggagcttcacggaggcaagagggtaatggagtgcctaaaaaaagctctaaaaatagcaaatcagtgcatggacccctctctacaagtgcagctttttatagaaattctgaacagatatatctatttttatgaaaaggaaaatgatgcggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatctgtaaaaaaaaaaaaaaaaaaaaaaaaaacaaaacccacaagcacttatcttggctactaatgaagctctccttttttttgtttgtttgtttgcttcattgttgattgtgtattttcttcattcctggggagtactaacccaaaagcgtctgtctcttgttttctagtccagtttgagattaatttagaagaaaggaatactgtatgtgaaattcatcttgggctttcccctaaattgcaagataaggccatgtgtaagattttccctaaaactagaatatattaatgcatgtttgagaattttaaagcaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgatttttttttttgcaccagtgaaacaataaagatgctattgaaacttctaaaactaggggtaccggctcgantcgtatctgctctttctt

SEQ ID NO: 361928 - DNA, 5919 bp, Homo sapiens
agggggcagtggcacctgggtcgaccctccttgtagcccctgctctctcccaccgccccgcactccagcgagtggagaaggggccccacagaccgttcgggattaagaccagcccgatttggcctgcgggataggggacagcaggaggaaggccgcgggcaggctgatccgggccggggtgggcggcggctcttggctgcggccgttgctgagagacggggcggcctctctgtggggttgacttggcatgtaggctttggggtccatgaaggcctgcggcctcctttaagtggaatcggtcacctgcctaccacgaggggaccggtagtcctaggtctgagcgtctggcccccggggcgcgtggaggccctgagactcggaggtggcgccgggacccgcccagatgttgcgtttctacctttgtgcctagttgtgctcggccgtccccacgccctcctggaggggtcgcagtgattccttggcctttcttggcctcatacccgccttcggctgcagtgtttgtcagcgagttctggggacctgcttacatgaatttcctggaaggactcaggctgtcttctaatcctgacggtcgcaaaggagactgattgtttactttagcatttgtgcattgggcgcaccttgcctcttttgtctcgccattgataaaatccaagtatttgacttgctggaagcagtacttctccttagggcccgtctatgacggcagcaaatcgtggtgtggctgttggccggtaaacttgaacttcctcaaaatgtgaatctttgtgtctggttcccacaaagcctacaacacagcagtcccctcaggatgagcaggaaaagctcttggatgaagccatacaggctgtgaaggtccagtcattccaaatgaagagatgcctggacaaaaacaagcttatggatgctctaaaacatgcttctaatatgcttggtgaactccggacttctatgttatcaccaaagagttactatgaactttatatggccatttctgatgaactgcactacttggaggtctacctgacagatgagtttgctaaaggaaggaaagtggcagatctctacgaacttgtacagtatgctggaaacattatcccaaggctttaccttttgatcacagttggagttgtatatgtcaagtcatttcctcagtccaggaaggatattttgaaagatttggtagaaatgtgccgtggtgtgcaacatcccttgaggggtctgtttcttcgaaattaccttcttcagtgtaccagaaatatcttacctgatgaaggagagccaacagatgaagaaacaactggtgacatcagtgattccatggattttgtactgctcaactttgcagaaatgaacaagctctgggtgcgaatgcagcatcagggacatagccgagatagagaaaaaagagaacgagaaagacaagaactgagaattttagtgggaacaaatttggtgcgcctcagtcagttggaaggtgtaaatgtggaacgttacaaacagattgttttgactggcatattggagcaagttgtaaactgtagggatgctttggctcaagaatatctcatggagtgtattattcaggttttccctgatgaatttcacctccagactttgaatccttttcttcgggcctgtgctgagttacaccagaatgtaaatgtgaagaacataatcattgctttaattgatagattagctttatttgctcaccgtgaagatggacctggaatcccagcggatattaaactttttgatatattttcacagcaggtggctacagtgatacagtctagacaagacatgccttcagaggatgttgtatctttacaagtctctctgattaatcttgccatgaaatgttaccctgatcgtgtggactatgttgataaagttctagaaacaacagtggagatattcaataagctcaaccttgaacatattgctaccagtagtgcagtttcaaaggaactcaccagacttttgaaaataccagttgacacttacaacaatattttaacagtcttgaaattaaaacattttcacccactctttgagtactttgactacgagtccagaaagagcatgagttgttatgtgcttagtaatgttctggattataacacagaaattgtctctcaagaccaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggcattttctctgtatgaagatgaaatcagcgattccaaagcacagctagctgccatcaccttgatcattggcacttttgaaaggatgaagtgcttcagtgaagagaatcatgaacctctgaggactcagtgtgcccttgctgcatccaaacttctaaagaaacctgatcagggccgagctgtgagcacctgtgcacatctcttctggtctggcagaaacacggacaaaaatggggaggagcttcacggaggcaagagggtaatggagtgcctaaaaaaagctctaaaaatagcaaatcagtgcatggacccctctctacaagtgcagctttttatagaaattctgaacagatatatctatttttatgaaaaggaaaatgatgcggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatctgtaaaaaaaaaaaaaaaaaaaaaaaaaacaaaacccacaagcacttatcttggctactaatgaagctctccttttttttgtttgtttgtttgcttcattgttgattgtgtattttcttcattcctggggagtactaacccaaaagcgtctgtctcttgttttctagtccagtttgagattaatttagaagaaaggaatactgtatgtgaaattcatcttgggctttcccctaaattgcaagataaggccatgtgtaagattttccctaaaactagaatatattaatgcatgtttgagaattttaaagcaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgatttttttttttgcaccagtgaaacaataaagatgctattaacaattttggagctttttttcccctttcatactatctttaattgataaaaagaactagtagtatggctatagagtttaatagtcattctcatatattcacagagctcacttaactctagttttaagcacttgttgaacaaggcagcatctactcttttagtcatttataccccttttctttcctcaactttaccctgcttttcccaaggcatgatgaattcacataaaccccccaaaggctcaccactgatactagttacctactatataataaaccatcccaaaacttactgtcttaaaacagcaaacatttatctcacaggtctctggatcaggaatttgggagcagcttagctggtggttctggcaaagagtgtggtgtaaggttgcaaacaagatactggttggggctgcagtcatctgatgctttgactggggctgacttttctgctcactgacctggctgttaggcagaggccccagttcctcttcttgagggcagaggccccagttcctctccttgagggcagaggcctaagttcctttccttgagggcagaggccccagttcctctccttgacggcccttccatagagtgtcctcacagcatggtggctggctttcccctgagtatgaaagcaagaaggaaaccacagtgcctttcagtggcctccctgtggaagtgacatgctcatttttgccttattctgtaagtggggagtcactaagtctagcctatattcaagggtaaggagagttaagctccacctcttaaagggaaaatttatagacattttcaaatgactacatcacttaacccctcaccatctgccctcccattgctagcacttgatgactagcccttgctgggctttacatgaacagatgtttcccaaagttataaaattagtaccactaaaatgtatcaaatgttaagccattctgtggtatgtcatagtccagcaaaccctttctgttctttgtaggtgttagtttaccccgtataaacctgattatggcttgacatgtccatattatttacatgttttgtgaaatacaactggaatagtagaaaagacatgagtcaagaacacttgagttggagagcttggtttgcaagtaaggtaatgtcagtacagtgtgtaaattatctcttattttctgggttgaggtaaacccaattttaaaaataataaaccaacaaaagtaaataaaagtgaaacaaaagcactgctagtatccttaacttacagattttttttgttgaacaaaaactgggtaccagatatagttaggcactgaatctaaaggtgaagaagatcatagcctctagcttcaagaacgttagtctgctgtgaagacagacctgtagttacagaagatggtaagggtttgtgcaggagagcagtgaagaagagctttgagggattggggatggggaagttctgcagagggttgtatgaattctcatggaacatcaagtccaatagtttatttagccttctgaggccagtgctttggcctgcagtcccaggctcctcagacccatgggctgaagcaagttatactcttggctgcctgtagtgaaatagatatttagaaattgacttagcatttaaaaccctttatagcaatttgacagagtaattttatgtctattggatgtaataaatatttggctttgtttccatgtacatccagtgagggttttattacgctaggtttcccttccatagattgtgcctttcaaaaatgctgaggtaggtttcccatttcttacctgtgatgtgttttacccagcacctccgcacacataacattcaggaccttaataaaattattcacttggtaagtgttcaagtctttctgatcaccccaagtagcatgactgatctgcaatttaaaattcctgtgatctgtaaaaaaaaaa

SEQ ID NO: 361929 - DNA, 5144 bp, Homo sapiens
agcgtcacatgaccgcgggaggctacgcgcggggcgggtgctgcttgctgcaggctctggggagtcgccatgcctacaacacagcagtcccctcaggatgagcaggaaaagctcttggatgaagccatacaggctgtgaaggtccagtcattccaaatgaagagatgcctggacaaaaacaagcttatggatgctctaaaacatgcttctaatatgcttggtgaactccggacttctatgttatcaccaaagagttactatgaactttatatggccatttctgatgaactgcactacttggaggtctacctgacagatgagtttgctaaaggaaggaaagtggcagatctctacgaacttgtacagtatgctggaaacattatcccaaggctttaccttttgatcacagttggagttgtatatgtcaagtcatttcctcagtccaggaaggatattttgaaagatttggtagaaatgtgccgtggtgtgcaacatcccttgaggggtctgtttcttcgaaattaccttcttcagtgtaccagaaatatcttacctgatgaaggagagccaacagatgaagaaacaactggtgacatcagtgattccatggattttgtactgctcaactttgcagaaatgaacaagctctgggtgcgaatgcagcatcagggacatagccgagatagagaaaaaagagaacgagaaagacaagtcagttggaaggtgtaaatgtggaacgttacaaacagattgttttgactggcatattggagcaagttgtaaactgtagggatgctttggctcaagaatatctcatggagtgtattattcaggttttccctgatgaatttcacctccagactttgaatccttttcttcgggcctgtgctgagttacaccagaatgtaaatgtgaagaacataatcattgctttaattgatagattagctttatttgctcaccgtgaagatggacctggaatcccagcggatattaaactttttgatatattttcacagcaggtggctacagtgatacagtctagacaagacatgccttcagaggatgttgtatctttacaagtctctctgattaatcttgccatgaaatgttaccctgatcgtgtggactatgttgataaagttctagaaacaacagtggagatattcaataagctcaaccttgaacatattgctaccagtagtgcagtttcaaaggaactcaccagacttttgaaaataccagttgacacttacaacaatattttaacagtcttgaaattaaaacattttcacccactctttgagtactttgactacgagtccagaaagagcatgagttgttatgtgcttagtaatgttctggattataacacagaaattgtctctcaagaccaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggcattttctctgtatgaagatgaaatcagcgattccaaagcacagctagctgccatcaccttgatcattggcacttttgaaaggatgaagtgcttcagtgaagagaatcatgaacctctgaggactcagtgtgcccttgctgcatccaaacttctaaagaaacctgatcagggccgagctgtgagcacctgtgcacatctcttctggtctggcagaaacacggacaaaaatggggaggagcttcacggaggcaagagggtaatggagtgcctaaaaaaagctctaaaaatagcaaatcagtgcatggacccctctctacaagtgcagctttttatagaaattctgaacagatatatctatttttatgaaaaggaaaatgatgcggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatctgtaaaaaaaaaaaaaaaaaaaaaaaaaacaaaacccacaagcacttatcttggctactaatgaagctctccttttttttgtttgtttgtttgcttcattgttgattgtgtattttcttcattcctggggagtactaacccaaaagcgtctgtctcttgttttctagtccagtttgagattaatttagaagaaaggaatactgtatgtgaaattcatcttgggctttcccctaaattgcaagataaggccatgtgtaagattttccctaaaactagaatatattaatgcatgtttgagaattttaaagcaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgatttttttttttgcaccagtgaaacaataaagatgctattaacaattttggagctttttttcccctttcatactatctttaattgataaaaagaactagtagtatggctatagagtttaatagtcattctcatatattcacagagctcacttaactctagttttaagcacttgttgaacaaggcagcatctactcttttagtcatttataccccttttctttcctcaactttaccctgcttttcccaaggcatgatgaattcacataaaccccccaaaggctcaccactgatactagttacctactatataataaaccatcccaaaacttactgtcttaaaacagcaaacatttatctcacaggtctctggatcaggaatttgggagcagcttagctggtggttctggcaaagagtgtggtgtaaggttgcaaacaagatactggttggggctgcagtcatctgatgctttgactggggctgacttttctgctcactgacctggctgttaggcagaggccccagttcctcttcttgagggcagaggccccagttcctctccttgagggcagaggcctaagttcctttccttgagggcagaggccccagttcctctccttgacggcccttccatagagtgtcctcacagcatggtggctggctttcccctgagtatgaaagcaagaaggaaaccacagtgcctttcagtggcctccctgtggaagtgacatgctcatttttgccttattctgtaagtggggagtcactaagtctagcctatattcaagggtaaggagagttaagctccacctcttaaagggaaaatttatagacattttcaaatgactacatcacttaacccctcaccatctgccctcccattgctagcacttgatgactagcccttgctgggctttacatgaacagatgtttcccaaagttataaaattagtaccactaaaatgtatcaaatgttaagccattctgtggtatgtcatagtccagcaaaccctttctgttctttgtaggtgttagtttaccccgtataaacctgattatggcttgacatgtccatattatttacatgttttgtgaaatacaactggaatagtagaaaagacatgagtcaagaacacttgagttggagagcttggtttgcaagtaaggtaatgtcagtacagtgtgtaaattatctcttattttctgggttgaggtaaacccaattttaaaaataataaaccaacaaaagtaaataaaagtgaaacaaaagcactgctagtatccttaacttacagattttttttgttgaacaaaaactgggtaccagatatagttaggcactgaatctaaaggtgaagaagatcatagcctctagcttcaagaacgttagtctgctgtgaagacagacctgtagttacagaagatggtaagggtttgtgcaggagagcagtgaagaagagctttgagggattggggatggggaagttctgcagagggttgtatgaattctcatggaacatcaagtccaatagtttatttagccttctgaggccagtgctttggcctgcagtcccaggctcctcagacccatgggctgaagcaagttatactcttggctgcctgtagtgaaatagatatttagaaattgacttagcatttaaaaccctttatagcaatttgacagagtaattttatgtctattggatgtaataaatatttggctttgtttccatgtacatccagtgagggttttattacgctaggtttcccttccatagattgtgcctttcaaaaatgctgaggtaggtttcccatttcttacctgtgatgtgttttacccagcacctccgcacacataacattcaggaccttaataaaattattcacttggtaagtgttcaagtctttctgatcaccccaagtagcatgactgatctgcaatttaaaattcctgtgatctgtaaaaaaaaaa

SEQ ID NO: 361930 - DNA, 4284 bp, Homo sapiens
  misc_feature (1)..(1): n is a, c, g, or t
ngagttacaccagaatgattatgttcttcacatttacattctggtgtaactgtgaagaacataatcattgctttaattgatagattagctttatttgctcaccgtgaagatggacctggaatcccagcggatattaaactttttgatatattttcacagcaggtggctacagtgatacagtctagacaagacatgccttcagaggatgttgtatctttacaagtctctctgattaatcttgccatgaaatgttaccctgatcgtgtggactatgttgataaagttctagaaacaacagtggagatattcaataagctcaaccttgaacatattgctaccagtagtgcagtttcaaaggaactcaccagacttttgaaaataccagttgacacttacaacaatattttaacagtcttgaaattaaaacattttcacccactctttgagtactttgactacgagtccagaaagagcatgagttgttatgtgcttagtaatgttctggattataacacagaaattgtctctcaagaccaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggcattttctctgtatgaagatgaaatcagcgattccaaagcacagctagctgccatcaccttgatcattggcacttttgaaaggatgaagtgcttcagtgaagagaatcatgaacctctgaggactcagtgtgcccttgctgcatccaaacttctaaagaaacctgatcagggccgagctgtgagcacctgtgcacatctcttctggtctggcagaaacacggacaaaaatggggaggagcttcacggaggcaagagggtaatggagtgcctaaaaaaagctctaaaaatagcaaatcagtgcatggacccctctctacaagtgcagctttttatagaaattctgaacagatatatctatttttatgaaaaggaaaatgatgcggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatctgtaaaaaaaaaaaaaaaaaaaaaaaaaacaaaacccacaagcacttatcttggctactaatgaagctctccttttttttgtttgtttgtttgcttcattgttgattgtgtattttcttcattcctggggagtactaacccaaaagcgtctgtctcttgttttctagtccagtttgagattaatttagaagaaaggaatactgtatgtgaaattcatcttgggctttcccctaaattgcaagataaggccatgtgtaagattttccctaaaactagaatatattaatgcatgtttgagaattttaaagcaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgatttttttttttgcaccagtgaaacaataaagatgctattaacaattttggagctttttttcccctttcatactatctttaattgataaaaagaactagtagtatggctatagagtttaatagtcattctcatatattcacagagctcacttaactctagttttaagcacttgttgaacaaggcagcatctactcttttagtcatttataccccttttctttcctcaactttaccctgcttttcccaaggcatgatgaattcacataaaccccccaaaggctcaccactgatactagttacctactatataataaaccatcccaaaacttactgtcttaaaacagcaaacatttatctcacaggtctctggatcaggaatttgggagcagcttagctggtggttctggcaaagagtgtggtgtaaggttgcaaacaagatactggttggggctgcagtcatctgatgctttgactggggctgacttttctgctcactgacctggctgttaggcagaggccccagttcctcttcttgagggcagaggccccagttcctctccttgagggcagaggcctaagttcctttccttgagggcagaggccccagttcctctccttgacggcccttccatagagtgtcctcacagcatggtggctggctttcccctgagtatgaaagcaagaaggaaaccacagtgcctttcagtggcctccctgtggaagtgacatgctcatttttgccttattctgtaagtggggagtcactaagtctagcctatattcaagggtaaggagagttaagctccacctcttaaagggaaaatttatagacattttcaaatgactacatcacttaacccctcaccatctgccctcccattgctagcacttgatgactagcccttgctgggctttacatgaacagatgtttcccaaagttataaaattagtaccactaaaatgtatcaaatgttaagccattctgtggtatgtcatagtccagcaaaccctttctgttctttgtaggtgttagtttaccccgtataaacctgattatggcttgacatgtccatattatttacatgttttgtgaaatacaactggaatagtagaaaagacatgagtcaagaacacttgagttggagagcttggtttgcaagtaaggtaatgtcagtacagtgtgtaaattatctcttattttctgggttgaggtaaacccaattttaaaaataataaaccaacaaaagtaaataaaagtgaaacaaaagcactgctagtatccttaacttacagattttttttgttgaacaaaaactgggtaccagatatagttaggcactgaatctaaaggtgaagaagatcatagcctctagcttcaagaacgttagtctgctgtgaagacagacctgtagttacagaagatggtaagggtttgtgcaggagagcagtgaagaagagctttgagggattggggatggggaagttctgcagagggttgtatgaattctcatggaacatcaagtccaatagtttatttagccttctgaggccagtgctttggcctgcagtcccaggctcctcagacccatgggctgaagcaagttatactcttggctgcctgtagtgaaatagatatttagaaattgacttagcatttaaaaccctttatagcaatttgacagagtaattttatgtctattggatgtaataaatatttggctttgtttccatgtacatccagtgagggttttattacgctaggtttcccttccatagattgtgcctttcaaaaatgctgaggtaggtttcccatttcttacctgtgatgtgttttacccagcacctccgcacacataacattcaggaccttaataaaattattcacttggtaagtgttcaagtctttctgatcaccccaagtagcatgactgatctgcaatttaaaattcctgtgatctgtaaaaaaaaaa

SEQ ID NO: 361931 - DNA, 4347 bp, Homo sapiens
agcgtcacatgaccgcgggaggctacgcgcggggcgggtgctgcttgctgcaggctctggggagtcgccatgcctacaacacagcagtcccctcaggatgagcaggaaaagctcttggatgaagccatacaggctgtgaaggtccagtcattccaaatgaagagatgcctggacaaaaacaagcttatggatgctctaaaacatgcttctaatatgcttggtgaactccggacttctatgttatcaccaaagagttactatgaactttatatggccatttctgatgaactgcactacttggaggtctacctgacagatgagtttgctaaaggaaggaaagtggcagatctctacgaacttgtacagtatgctggaaacattatcccaaggcttattgctaccagtagtgcagtttcaaaggaactcaccagacttttgaaaataccagttgacacttacaacaatattttaacagtcttgaaattaaaacattttcacccactctttgagtactttgactacgagtccagaaagagcatgagttgttatgtgcttagtaatgttctggattataacacagaaattgtctctcaagaccaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggcattttctctgtatgaagatgaaatcagcgattccaaagcacagctagctgccatcaccttgatcattggcacttttgaaaggatgaagtgcttcagtgaagagaatcatgaacctctgaggactcagtgtgcccttgctgcatccaaacttctaaagaaacctgatcagggccgagctgtgagcacctgtgcacatctcttctggtctggcagaaacacggacaaaaatggggaggagcttcacggaggcaagagggtaatggagtgcctaaaaaaagctctaaaaatagcaaatcagtgcatggacccctctctacaagtgcagctttttatagaaattctgaacagatatatctatttttatgaaaaggaaaatgatgcggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatctgtaaaaaaaaaaaaaaaaaaaaaaaaaacaaaacccacaagcacttatcttggctactaatgaagctctccttttttttgtttgtttgtttgcttcattgttgattgtgtattttcttcattcctggggagtactaacccaaaagcgtctgtctcttgttttctagtccagtttgagattaatttagaagaaaggaatactgtatgtgaaattcatcttgggctttcccctaaattgcaagataaggccatgtgtaagattttccctaaaactagaatatattaatgcatgtttgagaattttaaagcaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgatttttttttttgcaccagtgaaacaataaagatgctattaacaattttggagctttttttcccctttcatactatctttaattgataaaaagaactagtagtatggctatagagtttaatagtcattctcatatattcacagagctcacttaactctagttttaagcacttgttgaacaaggcagcatctactcttttagtcatttataccccttttctttcctcaactttaccctgcttttcccaaggcatgatgaattcacataaaccccccaaaggctcaccactgatactagttacctactatataataaaccatcccaaaacttactgtcttaaaacagcaaacatttatctcacaggtctctggatcaggaatttgggagcagcttagctggtggttctggcaaagagtgtggtgtaaggttgcaaacaagatactggttggggctgcagtcatctgatgctttgactggggctgacttttctgctcactgacctggctgttaggcagaggccccagttcctcttcttgagggcagaggccccagttcctctccttgagggcagaggcctaagttcctttccttgagggcagaggccccagttcctctccttgacggcccttccatagagtgtcctcacagcatggtggctggctttcccctgagtatgaaagcaagaaggaaaccacagtgcctttcagtggcctccctgtggaagtgacatgctcatttttgccttattctgtaagtggggagtcactaagtctagcctatattcaagggtaaggagagttaagctccacctcttaaagggaaaatttatagacattttcaaatgactacatcacttaacccctcaccatctgccctcccattgctagcacttgatgactagcccttgctgggctttacatgaacagatgtttcccaaagttataaaattagtaccactaaaatgtatcaaatgttaagccattctgtggtatgtcatagtccagcaaaccctttctgttctttgtaggtgttagtttaccccgtataaacctgattatggcttgacatgtccatattatttacatgttttgtgaaatacaactggaatagtagaaaagacatgagtcaagaacacttgagttggagagcttggtttgcaagtaaggtaatgtcagtacagtgtgtaaattatctcttattttctgggttgaggtaaacccaattttaaaaataataaaccaacaaaagtaaataaaagtgaaacaaaagcactgctagtatccttaacttacagattttttttgttgaacaaaaactgggtaccagatatagttaggcactgaatctaaaggtgaagaagatcatagcctctagcttcaagaacgttagtctgctgtgaagacagacctgtagttacagaagatggtaagggtttgtgcaggagagcagtgaagaagagctttgagggattggggatggggaagttctgcagagggttgtatgaattctcatggaacatcaagtccaatagtttatttagccttctgaggccagtgctttggcctgcagtcccaggctcctcagacccatgggctgaagcaagttatactcttggctgcctgtagtgaaatagatatttagaaattgacttagcatttaaaaccctttatagcaatttgacagagtaattttatgtctattggatgtaataaatatttggctttgtttccatgtacatccagtgagggttttattacgctaggtttcccttccatagattgtgcctttcaaaaatgctgaggtaggtttcccatttcttacctgtgatgtgttttacccagcacctccgcacacataacattcaggaccttaataaaattattcacttggtaagtgttcaagtctttctgatcaccccaagtagcatgactgatctgcaatttaaaattcctgtgatctgtaaaaaaaaaa

SEQ ID NO: 361932 - DNA, 1782 bp, Homo sapiens
agcgtcacatgaccgcgggaggctacgcgcggggcgggtgctgcttgctgcaggctctggggagtcgccatgcctacaacacagcagtcccctcaggatgagcaggaaaagctcttggatgaagccatacaggctgtgaaggtccagtcattccaaatgaagagatgcctggacaaaaacaagcttatggatgctctaaaacatgcttctaatatgcttggtgaactccggacttctatgttatcaccaaagagttactatgaactttatatggccatttctgatgaactgcactacttggaggtctacctgacagatgagtttgctaaaggaaggaaagtggcagatctctacgaacttgtacagtatgctggaaacattatcccaaggctttaccttttgatcacagttggagttgtatatgtcaagtcatttcctcagtccaggaaggatattttgaaagatttggtagaaatgtgccgtggtgtgcaacatcccttgaggggtctgtttcttcgaaattaccttcttcagtgtaccagaaatatcttacctgatgaaggagagccaacagatgaagaaacaactggtgacatcagtgattccatggattttgtactgctcaactttgcagaaatgaacaagctctgggtgcgaatgcagcatcagggacatagccgagatagagaaaaaagagaacgagaaagacaagaactgagaattttagtgggaacaaatttggtgcgcctcagtcagttggaaggtgtaaatgtggaacgttacaaacagattgttttgactggcatattggagcaagttgtaaactgtagggatgctttggctcaagaatatctcatggagtgtattattcaggttttccctgatgaatttcacctccagactttgaatccttttcttcgggcctgtgctgagttacaccagaatgtaaatgtgaagaacataatcattgctttaattgatagattagctttatttgctcaccgtgaagatggacctggaatcccagcggatattaaactttttgatatattttcacagcaggtggctacagtgatacagtctagacaagacatgccttcagaggatgttgtatctttacaagtctctctgattaatcttgccatgaaatgttaccctgatcgtgtggactatgttgataaagttctagaaacaacagtggagatattcaataagctcaaccttgaacatattgctaccagtagtgcagtttcaaaggaactcaccagacttttgaaaataccagttgacacttacaacaatattttaacagtcttgaaattaaaacattttcacccactctttgagtactttgactacgagtccagaaagagcatgagttgttatgtgcttagtaatgttctggattataacacagaaattgtctctcaagaccaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggattccatttggggattccatttggggattccatttggggattccatttggggggattccatttgg

SEQ ID NO: 361933 - DNA, 1457 bp, Homo sapiens
agcgtcacatgaccgcgggaggctacgcgcggggcgggtgctgcttgctgcaggctctggggagtcgccatgcctacaacacagcagtcccctcaggatgagcaggaaaagctcttggatgaagccatacaggctgtgaaggtccagtcattccaaatgaagagatgcctggacaaaaacaagcttatggatgctctaaaacatgcttctaatatgcttggtgaactccggacttctatgttatcaccaaagagttactatgaactttatatggccatttctgatgaactgcactacttggaggtctacctgacagatgagtttgctaaaggaaggaaagtggcagatctctacgaacttgtacagtatgctggaaacattatcccaaggctttaccttttgatcacagttggagttgtatatgtcaagtcatttcctcagtccaggaaggatattttgaaagatttggtagaaatgtgccgtggtgtgcaacatcccttgaggggtctgtttcttcgaaattaccttcttcagtgtaccagaaatatcttacctgatgaaggagagccaacagatgaagaaacaactggtgacatcagtgattccatggattttgtactgctcaactttgcagaaatgaacaagctctgggtgcgaatgcagcatcagggacatagccgagatagagaaaaaagagaacgagaaagacaagaactgagaattttagtgggaacaaatttggtgcgcctcagtcagttggaaggtgtaaatgtggaacgttacaaacagattgttttgactggcatattggagcaagttgtaaactgtagggatgctttggctcaagaatatctcatggagtgtattattcaggttttccctgatgaatttcacctccagactttgaatccttttcttcgggcctgtgctgagttacaccagaatgtaaatgtgaagaacataatcattgctttaattgatagattagctttatttgctcaccgtgaagatggacctggaatcccagcggatattaaactttttgatatattttcacagcaggtggctacagtgatacagtctagacaagacatgccttcagaggatgttgtatctttacaagtctctctgattaatcttgccatgaaatgttaccctgatcgtgtggactatgttgataaagttctagaaacaacagtggagatattcaataagctcaaccttgaacatattgctaccagtagtgcagtttcaaaggaactcaccagacttttgaaaataccagttgacacttacaacaatattttaacagtcttgaaattaaaacattttcacccactctttgagtactttgactacgagtccagaaagagcatgagttgttatgtgcttagtaatgttctggattataacacagaaattgtctctcaagaccaggtaagagaatacctacgtgc

SEQ ID NO: 361934 - DNA, 299 bp, Homo sapiens
actattactaagtcccctgccccaggaaggtcctgggtcacttgcagcaggagagagcagcagtctttctgccagtacatcagtctcagattcatcccagaaaaaagaagagcacaattattctctttttgtctccgacaacttgggtgaacagccaactaaatgcagtcctgaagaagatgaggaggacgaggaggatgttgatgatgaggaccatgatgaaggattcggcagtgagcattacatcattatataatggtacttcctcaagttgctgggtgacagtgagactccatctc

SEQ ID NO: 361935 - DNA, 5263 bp, Homo sapiens
gtcaggaaggacataaacaaaacaaacccgaggcagcatggagaggggccgtggcccctgcagcggaaccggacccagtccctgagccgcccctacacccacagacagcatcgcacagaattattttaaaaaaaagcagtgatccaagcaattgaattggaagcactctggggaaacctgctgtttattgtggaaatcatcttcgatcttggaattgaaagtaaagctggaaaggaatttacaaacaagaaaaaaaagaagtttggaatcggattcacaggatctgggcttggaaatgcctcagcctagtgtaagcggaatggatccgcctttcggggatgcctttcgaagccacaccttttcggaacaaactctgatgagcacagatctcttagcaaacagttcggatccagatttcatgtatgaactggtcatgatgaaggattcggcagtgagcatgaactgtctgaaaatgaggaggaggaagaagaggaagaggattatgaagatgacaaggatgatgatattagtgatactttctctgaaccaggctatgaaaatgattctgtagaagacctgaaggaggtgacttcaatatcttcacggaagagaggtaaaagaagatacttctgggagtatagtgaacaacttacaccatcacagcaagagaggatgctgagaccatctgagtggaaccgagatactttgccaagtaatatgtatcagaaaaatggcttacatcatggaaaatatgcagtaaagaagtcacggagaactgatgtagaagacctgactccaaatcctaaaaaactcctccagataggcaatgaacttcggaaactgaataaggtgattagtgacctgactccagtcagtgagcttcccttaacagcccgaccaaggtcaaggaaggaaaaaaataagctggcttccagagcttgtcggttaaagaagaaagcccagtatgaagctaataaagtgaaattatggggcctcaacacagaatatgataatttattgtttgtaatcaactccatcaagcaagagattgtaaaccgggtacagaatccaagagatgagagaggacccaacatggggcagaagcttgaaatcctcattaaagatactctcggtctaccagttgctgggcaaacctcagaatttgttaaccaagtgttagagaagactgcagaagggaatcccactggaggccttgtaggattaaggataccaacatcaaaggtgtaatcagcctcattggaccactggtcagaaatgtctgcgttttgtcacgttatccattgtaaattttcattctgttttgcatgtcagttagcattatgtaaacatttacaattaggttacattgttttaagaactaagtagcataagtgaagcatgatccaaaatacttgattattgcattttcagagcataaaccatgattaaaactgctactggcatcagaattgaaaatcatatgtttaagtaaatgttaggtacagattacaaaaatctgttaaagcaaaacattttggaggagtgaaatagtaaaatgccaagtattgtggcagatttatgctctgaaccacacaaaaaaattgaggaagcatttttttaaacagtcggtttaaattgtttttagaattattgctttttgttctaattttccacaaccattaatctcacttgtatatggcacacccagcacttgtgcctgtgggccatattagatgttcattgtcagagctcaagatgatatatataaatatatatatatatatatatatatatacacacacacacaaatgtctgtgcaagtaagaaaaaaaaagcatattctttgtgccttgtattttggggaaactctaaaactggtaatattttgtatgatgaaaaccctaatgagaaaaaacaagatatatagatggaaaaattatggggtttaaatgtttttttgttccaactctttttcagattttttgaatgtatataggactatgttgaaatgtagatatatgccacagagtctgtgtattgtataaaaaacaaaacaaaaaacaacaaaaaaaagatggctctagaaaactcatatttcggtacttgaccggaagaagacaaatacttgcacattattgcgattgttttattttttgtaccaaagacaaatgcaactgatatggcaaactgccagtctaagtaaagttttgcacagcttacatgatactgtatgaatgtatgaaaaaaaaggagaaaaaaaagaaaaaaaaaggtcagggttagggatcttactgaactgtgaattttatttctgtttgggtccaattatctacagaaggagcatccatacatacaaatattattttgctgttcctctagttcgcttccatagtagataagttggtggccatttagatgtcttttatttctgcacttattgtaggaaattttaatatatttcattttagtaagctattgataaaatagtttttgactttgaaaattaaaatgtttatttagcttattgtagtatacttccaccagacaacaaaatagattatttttattgtattatgtatatatatatatgtaaagaaagaaaaaagctaaaaatatctaattctttagttgccacttttccgattgatgtattattgtgcatgtaatattttcaaagatcaacacaggctaaaacaaaaacaatttatagatttttatatttttgtacaggtattttcaaactagcttcttcaaacttaacatgtgacttattcttctatagtttctagaattgagaaacattaacacatttagtttttaggtgctcttttttgctcatataaaacagcttcattagtcagtgttttaactgtgttcaagctttacctcttgatgagaaatttcttatgtcaaggcagcattataaaccttcccccacagatttttccatcctgtctctcttactgttttattctcaaatcttgtgctttgaactctgaaaactggtggcttaaaaactaaaaaaagaaaaaaagcatatttagcaaggaaaaaaataccaaaaatttcaggcatagctgctggaaaaattatctatttctccattacccactgtaggatttcttttttaattatactttgactataaagtgtcaaagtataatttgttcttttcttttactttgttaccccatttgtaagctatagcatatgaagctatatatatagcttgtgaaggtttgatctagaacacccagtaacaaatgaacaatgttgcttacctgcttctttgacatcttaaaaaagaaatccaaggaggattgtaaggattgtcttaccaccttagctgaactgtgatgcacaagatttttctatgtgtttggtggaaatgtacctggtttgtacattcacgctaaacagatgataagctcaagtctgatggtttaatagaatgtaagttcatcgtttaaagcttttcctttttaggttggagaaggcaaaacacaggcttgcaagttggaagtatatgaagtcttgacagagtgtgtctggtaaattgaaaagtgtttcaaactatggcagttttgcaatcaggtgaaaatcacctcatgatattcagctgataaggtttataaaattgcccctttctagctgctctgttaggaattctggtttttgatacttttttcctgtctgcaaaccagaatttgattttttggtcttgcatttcaaaaaaaaaaagactttgaatctgtttagtagattccatatctttgagtttcagtgttttatatgtactacttaagttaaatagttaaaagcttttaaatagttgagctttttaatgttgacactttattttgtacctatttatatatgtatgtatatcttagaaaagcactttgttaaaaaaaaattgcattttatatgattcctgccatttgctgctaaatctgggctggtcagaatgctgcagcgatacttgatctatataaaaacctggcagtaaaatgtagagtgaaagttaaatcctcttgctgttttaactttatcataaagatgacataggcaagctgtgcagctttacattttaaccaggggactctgtggcatttaaaaccgtctagaaatggttgtactttaatgccagtaataatctgcttcctctattgtcattaaaatatatacgtttagtgtatcacacaaaccaatcttataagggtaatgtaaaaaccccaacaattgtacatgttctgtttttgaaaattgtggcatgtatttttgggtgaagatcattagagaagagttctctaaaggttttctgtgttcatacatggtatacagatagctcataatgaagtccagaatcttacttttaagtgaaggcattgtgaattcacctcaagtaaacccattgttccaaagcaattataaactttgactctagtactactatgatttaaaaaaaaaaaaaaccaacaaaaaccttttttcctagtttcagatacactggattctttatagagtttgtctccatatgaaagcatgctgtccagtcgctcttgttaagatcttgtctgagttttgaattgggtgccacacttttccagtcaatataattgcttgttctactgtaccatgtatgattcttgtcctttcctatatccttcatgacagattatgatgtggctttatattgtgccttacttgtacatttaaaactaaacgtcttcattcccttccacttcctacatctttaactttgacctttttggtaagagaatcagaactattacaaaagcatcatgaaggatttcagatgggtatggtttcaaattccctctctttatagttattttatatttgtatgaaagaccagttttggatggtctttgaatataggggggaaagattagcagtaatttcactacatcccttttctctgactttcatgcatttctcatacatcttctttctgatgcttgactttatttgcttcctagcaatagtctgcatttaaagaaaggtgtgttcaattcatcagcttgaaattgactatttcatttttccaggattttttaggagaagagtacccattttgttttataaaaacagatgacaagtctctttaaaagaaacagaagtacagtacttttgaaatacaatgctgttagtttggatttctttttatatatatatataatattcatacaatgatctgatgtttgccttcattaataaagctgttagtttattcaccaaa

SEQ ID NO: 361936 - DNA, 4987 bp, Homo sapiens
actattactaagtcccctgccccaggaaggtcctgggtcacttgcagcaggagagagcagcagtctttctgccagtacatcagtctcagattcatcccagaaaaaagaagagcacaattattctctttttgtctccgacaacttgggtgaacagccaactaaatgcagtcctgaagaagatgaggaggacgaggaggatgttgatgatgaggaccatgatgaaggattcggcagtgagcatgaactgtctgaaaatgaggaggaggaagaagaggaagaggattatgaagatgacaaggatgatgatattagtgatactttctctgaaccaggctatgaaaatgattctgtagaagacctgaaggaggtgacttcaatatcttcacggaagagaggtaaaagaagatacttctgggagtatagtgaacaacttacaccatcacagcaagagaggatgctgagaccatctgagtggaaccgagatactttgccaagtaatatgtatcagaaaaatggcttacatcatggaaaatatgcagtaaagaagtcacggagaactgatgtagaagacctgactccaaatcctaaaaaactcctccagataggcaatgaacttcggaaactgaataaggtgattagtgacctgactccagtcagtgagcttcccttaacagcccgaccaaggtcaaggaaggaaaaaaataagctggcttccagagcttgtcggttaaagaagaaagcccagtatgaagctaataaagtgaaattatggggcctcaacacagaatatgataatttattgtttgtaatcaactccatcaagcaagagattgtaaaccgggtacagaatccaagagatgagagaggacccaacatggggcagaagcttgaaatcctcattaaagatactctcggtctaccagttgctgggcaaacctcagaatttgttaaccaagtgttagagaagactgcagaagggaatcccactggaggccttgtaggattaaggataccaacatcaaaggtgtaatcagcctcattggaccactggtcagaaatgtctgcgttttgtcacgttatccattgtaaattttcattctgttttgcatgtcagttagcattatgtaaacatttacaattaggttacattgttttaagaactaagtagcataagtgaagcatgatccaaaatacttgattattgcattttcagagcataaaccatgattaaaactgctactggcatcagaattgaaaatcatatgtttaagtaaatgttaggtacagattacaaaaatctgttaaagcaaaacattttggaggagtgaaatagtaaaatgccaagtattgtggcagatttatgctctgaaccacacaaaaaaattgaggaagcatttttttaaacagtcggtttaaattgtttttagaattattgctttttgttctaattttccacaaccattaatctcacttgtatatggcacacccagcacttgtgcctgtgggccatattagatgttcattgtcagagctcaagatgatatatataaatatatatatatatatatatatatatacacacacacacaaatgtctgtgcaagtaagaaaaaaaaagcatattctttgtgccttgtattttggggaaactctaaaactggtaatattttgtatgatgaaaaccctaatgagaaaaaacaagatatatagatggaaaaattatggggtttaaatgtttttttgttccaactctttttcagattttttgaatgtatataggactatgttgaaatgtagatatatgccacagagtctgtgtattgtataaaaaacaaaacaaaaaacaacaaaaaaaagatggctctagaaaactcatatttcggtacttgaccggaagaagacaaatacttgcacattattgcgattgttttattttttgtaccaaagacaaatgcaactgatatggcaaactgccagtctaagtaaagttttgcacagcttacatgatactgtatgaatgtatgaaaaaaaaggagaaaaaaaagaaaaaaaaaggtcagggttagggatcttactgaactgtgaattttatttctgtttgggtccaattatctacagaaggagcatccatacatacaaatattattttgctgttcctctagttcgcttccatagtagataagttggtggccatttagatgtcttttatttctgcacttattgtaggaaattttaatatatttcattttagtaagctattgataaaatagtttttgactttgaaaattaaaatgtttatttagcttattgtagtatacttccaccagacaacaaaatagattatttttattgtattatgtatatatatatatgtaaagaaagaaaaaagctaaaaatatctaattctttagttgccacttttccgattgatgtattattgtgcatgtaatattttcaaagatcaacacaggctaaaacaaaaacaatttatagatttttatatttttgtacaggtattttcaaactagcttcttcaaacttaacatgtgacttattcttctatagtttctagaattgagaaacattaacacatttagtttttaggtgctcttttttgctcatataaaacagcttcattagtcagtgttttaactgtgttcaagctttacctcttgatgagaaatttcttatgtcaaggcagcattataaaccttcccccacagatttttccatcctgtctctcttactgttttattctcaaatcttgtgctttgaactctgaaaactggtggcttaaaaactaaaaaaagaaaaaaagcatatttagcaaggaaaaaaataccaaaaatttcaggcatagctgctggaaaaattatctatttctccattacccactgtaggatttcttttttaattatactttgactataaagtgtcaaagtataatttgttcttttcttttactttgttaccccatttgtaagctatagcatatgaagctatatatatagcttgtgaaggtttgatctagaacacccagtaacaaatgaacaatgttgcttacctgcttctttgacatcttaaaaaagaaatccaaggaggattgtaaggattgtcttaccaccttagctgaactgtgatgcacaagatttttctatgtgtttggtggaaatgtacctggtttgtacattcacgctaaacagatgataagctcaagtctgatggtttaatagaatgtaagttcatcgtttaaagcttttcctttttaggttggagaaggcaaaacacaggcttgcaagttggaagtatatgaagtcttgacagagtgtgtctggtaaattgaaaagtgtttcaaactatggcagttttgcaatcaggtgaaaatcacctcatgatattcagctgataaggtttataaaattgcccctttctagctgctctgttaggaattctggtttttgatacttttttcctgtctgcaaaccagaatttgattttttggtcttgcatttcaaaaaaaaaaagactttgaatctgtttagtagattccatatctttgagtttcagtgttttatatgtactacttaagttaaatagttaaaagcttttaaatagttgagctttttaatgttgacactttattttgtacctatttatatatgtatgtatatcttagaaaagcactttgttaaatgctgcagcgatacttgatctatataaaaacctggcagtaaaatgtagagtgaaagttaaatcctcttgctgttttaactttatcataaagatgacataggcaagctgtgcagctttacattttaaccaggggactctgtggcatttaaaaccgtctagaaatggttgtactttaatgccagtaataatctgcttcctctattgtcattaaaatatatacgtttagtgtatcacacaaaccaatcttataagggtaatgtaaaaaccccaacaattgtacatgttctgtttttgaaaattgtggcatgtatttttgggtgaagatcattagagaagagttctctaaaggttttctgtgttcatacatggtatacagatagctcataatgaagtccagaatcttacttttaagtgaaggcattgtgaattcacctcaagtaaacccattgttccaaagcaattataaactttgactctagtactactatgatttaaaaaaaaaaaaaaccaacaaaaaccttttttcctagtttcagatacactggattctttatagagtttgtctccatatgaaagcatgctgtccagtcgctcttgttaagatcttgtctgagttttgaattgggtgccacacttttccagtcaatataattgcttgttctactgtaccatgtatgattcttgtcctttcctatatccttcatgacagattatgatgtggctttatattgtgccttacttgtacatttaaaactaaacgtcttcattcccttccacttcctacatctttaactttgacctttttggtaagagaatcagaactattacaaaagcatcatgaaggatttcagatgggtatggtttcaaattccctctctttatagttattttatatttgtatgaaagaccagttttggatggtctttgaatataggggggaaagattagcagtaatttcactacatcccttttctctgactttcatgcatttctcatacatcttctttctgatgcttgactttatttgcttcctagcaatagtctgcatttaaagaaaggtgtgttcaattcatcagcttgaaattgactatttcatttttccaggattttttaggagaagagtacccattttgttttataaaaacagatgacaagtctctttaaaagaaacagaagtacagtacttttgaaatacaatgctgttagtttggatttctttttatatatatatataatattcatacaatgatctgatgtttgccttcattaataaagctgttagtttattcaccaaa

SEQ ID NO: 361937 - DNA, 2704 bp, Homo sapiens
gcggccgcctactactactaaattcgcggccgcgtcgacgaaaaaagctaaaaatatctaattctttagttgccacttttccgattgatgtattattgtgcatgtaatattttcaaagatcaacacaggctaaaacaaaaacaatttatagatttttatatttttgtacaggtattttcaaactagcttcttcaaacttaacatgtgacttattcttctatagtttctagaattgagaaacattaacacatttagtttttaggtgctcttttttgctcatataaaacagcttcattagtcagtgttttaactgtgttcaagctttacctcttgatgagaaatttcttatgtcaaggcagcattataaaccttcccccacagatttttccatcctgtctctcttactgttttattctcaaatcttgtgctttgaactctgaaaactggtggcttaaaaactaaaaaaagaaaaaaagcatatttagcaaggaaaaaaataccaaaaatttcaggcatagctgctggaaaaattatctatttctccattacccactgtaggatttcttttttaattatactttgactataaagtgtcaaagtataatttgttcttttcttttactttgttaccccatttgtaagctatagcatatgaagctatatatatagcttgtgaaggtttgatctagaacacccagtaacaaatgaacaatgttgcttacctgcttctttgacatcttaaaaaagaaatccaaggaggattgtaaggattgtcttaccaccttagctgaactgtgatgcacaagatttttctatgtgtttggtggaaatgtacctggtttgtacattcacgctaaacagatgataagctcaagtctgatggtttaatagaatgtaagttcatcgtttaaagcttttcctttttaggttggagaaggcaaaacacaggcttgcaagttggaagtatatgaagtcttgacagagtgtgtctggtaaattgaaaagtgtttcaaactatggcagttttgcaatcaggtgaaaatcacctcatgatattcagctgataaggtttataaaattgcccctttctagctgctctgttaggaattctggtttttgatacttttttcctgtctgcaaaccagaatttgattttttggtcttgcatttcaaaaaaaaaaagactttgaatctgtttagtagattccatatctttgagtttcagtgttttatatgtactacttaagttaaatagttaaaagcttttaaatagttgagctttttaatgttgacactttattttgtacctatttatatatgtatgtatatcttagaaaagcactttgttaaaaaaaaattgcattttatatgattcctgccatttgctgctaaatctgggctggtcagaatgctgcagcgatacttgatctatataaaaacctggcagtaaaatgtagagtgaaagttaaatcctcttgctgttttaactttatcataaagatgacataggcaagctgtgcagctttacattttaaccaggggactctgtggcatttaaaaccgtctagaaatggttgtactttaatgccagtaataatctgcttcctctattgtcattaaaatatatacgtttagtgtatcacacaaaccaatcttataagggtaatgtaaaaaccccaacaattgtacatgttctgtttttgaaaattgtggcatgtatttttgggtgaagatcattagagaagagttctctaaaggttttctgtgttcatacatggtatacagatagctcataatgaagtccagaatcttacttttaagtgaaggcattgtgaattcacctcaagtaaacccattgttccaaagcaattataaactttgactctagtactactatgatttaaaaaaaaaaaaaaccaacaaaaaccttttttcctagtttcagatacactggattctttatagagtttgtctccatatgaaagcatgctgtccagtcgctcttgttaagatcttgtctgagttttgaattgggtgccacacttttccagtcaatataattgcttgttctactgtaccatgtatgattcttgtcctttcctatatccttcatgacagattatgatgtggctttatattgtgccttacttgtacatttaaaactaaacgtcttcattcccttccacttcctacatctttaactttgacctttttggtaagagaatcagaactattacaaaagcatcatgaaggatttcagatgggtatggtttcaaattccctctctttatagttattttatatttgtatgaaagaccagttttggatggtctttgaatataggggggaaagattagcagtaatttcactacatcccttttctctgactttcatgcatttctcatacatcttctttctgatgcttgactttatttgcttcctagcaatagtctgcatttaaagaaaggtgtgttcaattcatcagcttgaaattgactatttcatttttccaggattttttaggagaagagtacccattttgttttataaaaacagatgacaagtctctttaaaagaaacagaagtacagtacttttgaaatacaatgctgttagtttggatttctttttatatatatatataatattcatacaatgatctgatgtttgccttcattaataaagctgttagtttattcaccaaa

SEQ ID NO: 361938 - DNA, 681 bp, Homo sapiens
gtcaggaaggacataaacaaaacaaacccgaggcagcatggagaggggccgtggcccctgcagcggaaccggacccagtccctgagccgcccctacacccacagacagcatcgcacagaattattttaaaaaaaagcagtgatccaagcaattgaattggaagcactctggggaaacctgctgtttattgtggaaatcatcttcgatcttggaattgaaagtaaagctggaaaggaatttacaaacaagaaaaaaaagaagtttggaatcggattcacaggatctgggcttggaaatgcctcagcctagtgtaagcggaatggatccgcctttcggggatgcctttcgaagccacaccttttcggaacaaactctgatgagcacagatctcttagcaaacagttcggatccagatttcatgtatgaactggtcatgatgaaggattcggcagtgagcatgaactgtctgaaaatgaggaggaggaagaagaggaagaggattatgaagatgacaaggatgatgatattagtgatactttctctgaaccaggtattataatgcttgcaagcttaccagactgacctttgtattactattttgaaatagaaaggtttttgtttctgttttgtttggataatttctttattttagtttgggaattaaatgacttaaaccttgga

SEQ ID NO: 361939 - DNA, 1068 bp, Homo sapiens
gtcaggaaggacataaacaaaacaaacccgaggcagcatggagaggggccgtggcccctgcagcggaaccggacccagtccctgagccgcccctacacccacagacagcatcgcacagaattattttaaaaaaaagcagtgatccaagcaattgaattggaagcactctggggaaacctgctgtttattgtggaaatcatcttcgatcttggaattgaaagtaaagctggaaaggaatttacaaacaagaaaaaaaagaagtttggaatcggattcacaggatctgggcttggaaatgcctcagcctagtgtaagcggaatggatccgcctttcggggatgcctttcgaagccacaccttttcggaacaaactctgatgagcacagatctcttagcaaacagttcggatccagatttcatgtatgaactggtgatagagagatgaactaccaacagaatcctagagacaactttctttctttggaggactgcaaagacattgaaaatctggagtctttcacagatgtcctggataatgagggtgctttaacctcaaactgggaacagtgggatacatactgtgaagacctaacgaaatataccaaactaaccagctgtgacatctggggaacaaaagaagtggattacttgggtcttgatgacttttctagtccttaccaagatgaagaggttataagtaaaactccaactttagctcaacttaatagtgaggactcacagtctgtttctgattccctttattaccccgattcacttttcagtgtcaaacaaaatcccttaccctcttcattccctggtaaaaagatcacaagcagagcagctgctcctgtgtgttcttctaagactctgcaggctgaggtccctttgtcagactgtgtccaaaaagcaagtaaacccacttcaagcacacaaatcatggtgaagaccaacatgtatcataatgaaaaggtgaactttcatgttgaatgtaaagactatgtaaaaaaggcaaaggtaaagatcaacccagtgcaacagagccggcccttgttgagccagattcacaca

SEQ ID NO: 361940 - DNA, 5045 bp, Homo sapiens
actattactaagtcccctgccccaggaaggtcctgggtcacttgcagcaggagagagcagcagtctttctgccagtacatcagtctcagattcatcccagaaaaaagaagagcacaattattctctttttgtctccgacaacttgggtgaacagccaactaaatgcagtcctgaagaagatgaggaggacgaggaggatgttgatgatgaggaccatgatgaaggattcggcagtgagcatgaactgtctgaaaatgaggaggaggaagaagaggaagaggattatgaagatgacaaggatgatgatattagtgatactttctctgaaccaggctatgaaaatgattctgtagaagacctgaaggaggtgacttcaatatcttcacggaagagaggtaaaagaagatacttctgggagtatagtgaacaacttacaccatcacagcaagagaggatgctgagaccatctgagtggaaccgagatactttgccaagtaatatgtatcagaaaaatggcttacatcatggaaaatatgcagtaaagaagtcacggagaactgatgtagaagacctgactccaaatcctaaaaaactcctccagataggcaatgaacttcggaaactgaataaggtgattagtgacctgactccagtcagtgagcttcccttaacagcccgaccaaggtcaaggaaggaaaaaaataagctggcttccagagcttgtcggttaaagaagaaagcccagtatgaagctaataaagtgaaattatggggcctcaacacagaatatgataatttattgtttgtaatcaactccatcaagcaagagattgtaaaccgggtacagaatccaagagatgagagaggacccaacatggggcagaagcttgaaatcctcattaaagatactctcggtctaccagttgctgggcaaacctcagaatttgttaaccaagtgttagagaagactgcagaagggaatcccactggaggccttgtaggattaaggataccaacatcaaaggtgtaatcagcctcattggaccactggtcagaaatgtctgcgttttgtcacgttatccattgtaaattttcattctgttttgcatgtcagttagcattatgtaaacatttacaattaggttacattgttttaagaactaagtagcataagtgaagcatgatccaaaatacttgattattgcattttcagagcataaaccatgattaaaactgctactggcatcagaattgaaaatcatatgtttaagtaaatgttaggtacagattacaaaaatctgttaaagcaaaacattttggaggagtgaaatagtaaaatgccaagtattgtggcagatttatgctctgaaccacacaaaaaaattgaggaagcatttttttaaacagtcggtttaaattgtttttagaattattgctttttgttctaattttccacaaccattaatctcacttgtatatggcacacccagcacttgtgcctgtgggccatattagatgttcattgtcagagctcaagatgatatatataaatatatatatatatatatatatatatacacacacacacaaatgtctgtgcaagtaagaaaaaaaaagcatattctttgtgccttgtattttggggaaactctaaaactggtaatattttgtatgatgaaaaccctaatgagaaaaaacaagatatatagatggaaaaattatggggtttaaatgtttttttgttccaactctttttcagattttttgaatgtatataggactatgttgaaatgtagatatatgccacagagtctgtgtattgtataaaaaacaaaacaaaaaacaacaaaaaaaagatggctctagaaaactcatatttcggtacttgaccggaagaagacaaatacttgcacattattgcgattgttttattttttgtaccaaagacaaatgcaactgatatggcaaactgccagtctaagtaaagttttgcacagcttacatgatactgtatgaatgtatgaaaaaaaaggagaaaaaaaagaaaaaaaaaggtcagggttagggatcttactgaactgtgaattttatttctgtttgggtccaattatctacagaaggagcatccatacatacaaatattattttgctgttcctctagttcgcttccatagtagataagttggtggccatttagatgtcttttatttctgcacttattgtaggaaattttaatatatttcattttagtaagctattgataaaatagtttttgactttgaaaattaaaatgtttatttagcttattgtagtatacttccaccagacaacaaaatagattatttttattgtattatgtatatatatatatgtaaagaaagaaaaaagctaaaaatatctaattctttagttgccacttttccgattgatgtattattgtgcatgtaatattttcaaagatcaacacaggctaaaacaaaaacaatttatagatttttatatttttgtacaggtattttcaaactagcttcttcaaacttaacatgtgacttattcttctatagtttctagaattgagaaacattaacacatttagtttttaggtgctcttttttgctcatataaaacagcttcattagtcagtgttttaactgtgttcaagctttacctcttgatgagaaatttcttatgtcaaggcagcattataaaccttcccccacagatttttccatcctgtctctcttactgttttattctcaaatcttgtgctttgaactctgaaaactggtggcttaaaaactaaaaaaagaaaaaaagcatatttagcaaggaaaaaaataccaaaaatttcaggcatagctgctggaaaaattatctatttctccattacccactgtaggatttcttttttaattatactttgactataaagtgtcaaagtataatttgttcttttcttttactttgttaccccatttgtaagctatagcatatgaagctatatatatagcttgtgaaggtttgatctagaacacccagtaacaaatgaacaatgttgcttacctgcttctttgacatcttaaaaaagaaatccaaggaggattgtaaggattgtcttaccaccttagctgaactgtgatgcacaagatttttctatgtgtttggtggaaatgtacctggtttgtacattcacgctaaacagatgataagctcaagtctgatggtttaatagaatgtaagttcatcgtttaaagcttttcctttttaggttggagaaggcaaaacacaggcttgcaagttggaagtatatgaagtcttgacagagtgtgtctggtaaattgaaaagtgtttcaaactatggcagttttgcaatcaggtgaaaatcacctcatgatattcagctgataaggtttataaaattgcccctttctagctgctctgttaggaattctggtttttgatacttttttcctgtctgcaaaccagaatttgattttttggtcttgcatttcaaaaaaaaaaagactttgaatctgtttagtagattccatatctttgagtttcagtgttttatatgtactacttaagttaaatagttaaaagcttttaaatagttgagctttttaatgttgacactttattttgtacctatttatatatgtatgtatatcttagaaaagcactttgttaaaaaaaaattgcattttatatgattcctgccatttgctgctaaatctgggctggtcagaatgctgcagcgatacttgatctatataaaaacctggcagtaaaatgtagagtgaaagttaaatcctcttgctgttttaactttatcataaagatgacataggcaagctgtgcagctttacattttaaccaggggactctgtggcatttaaaaccgtctagaaatggttgtactttaatgccagtaataatctgcttcctctattgtcattaaaatatatacgtttagtgtatcacacaaaccaatcttataagggtaatgtaaaaaccccaacaattgtacatgttctgtttttgaaaattgtggcatgtatttttgggtgaagatcattagagaagagttctctaaaggttttctgtgttcatacatggtatacagatagctcataatgaagtccagaatcttacttttaagtgaaggcattgtgaattcacctcaagtaaacccattgttccaaagcaattataaactttgactctagtactactatgatttaaaaaaaaaaaaaaccaacaaaaaccttttttcctagtttcagatacactggattctttatagagtttgtctccatatgaaagcatgctgtccagtcgctcttgttaagatcttgtctgagttttgaattgggtgccacacttttccagtcaatataattgcttgttctactgtaccatgtatgattcttgtcctttcctatatccttcatgacagattatgatgtggctttatattgtgccttacttgtacatttaaaactaaacgtcttcattcccttccacttcctacatctttaactttgacctttttggtaagagaatcagaactattacaaaagcatcatgaaggatttcagatgggtatggtttcaaattccctctctttatagttattttatatttgtatgaaagaccagttttggatggtctttgaatataggggggaaagattagcagtaatttcactacatcccttttctctgactttcatgcatttctcatacatcttctttctgatgcttgactttatttgcttcctagcaatagtctgcatttaaagaaaggtgtgttcaattcatcagcttgaaattgactatttcatttttccaggattttttaggagaagagtacccattttgttttataaaaacagatgacaagtctctttaaaagaaacagaagtacagtacttttgaaatacaatgctgttagtttggatttctttttatatatatatataatattcatacaatgatctgatgtttgccttcattaataaagctgttagtttattcaccaaa

SEQ ID NO: 361941 - DNA, 3396 bp, Homo sapiens
  misc_feature (3297)..(3297): n is a, c, g, or t
actattactaagtcccctgccccaggaaggtcctgggtcacttgcagcaggagagagcagcagtctttctgccagtacatcagtctcagattcatcccagaaaaaagaagagcacaattattctctttttgtctccgacaacttgggtgaacagccaactaaatgcagtcctgaagaagatgaggaggacgaggaggatgttgatgatgaggaccatgatgaaggattcggcagtgagcatgaactgtctgaaaatgaggaggaggaagaagaggaagaggattatgaagatgacaaggatgatgatattagtgatactttctctgaaccaggctatgaaaatgattctgtagaagacctgaaggaggtgacttcaatatcttcacggaagagaggtaaaagaagatacttctgggagtatagtgaacaacttacaccatcacagcaagagaggatgctgagaccatctgagtggaaccgagatactttgccaagtaatatgtatcagaaaaatggcttacatcatggaaaatatgcagtaaagaagtcacggagaactgatgtagaagacctgactccaaatcctaaaaaactcctccagataggcaatgaacttcggaaactgaataaggtgattagtgacctgactccagtcagtgagcttcccttaacagcccgaccaaggtcaaggaaggaaaaaaataagctggcttccagagcttgtcggttaaagaagaaagcccagtatgaagctaataaagtgaaattatggggcctcaacacagaatatgataatttattgtttgtaatcaactccatcaagcaagagattgtaaaccgggtacagaatccaagagatgagagaggacccaacatggggcagaagcttgaaatcctcattaaagatactctcggtctaccagttgctgggcaaacctcagaatttgttaaccaagtgttagagaagactgcagaagggaatcccactggaggccttgtaggattaaggataccaacatcaaaggtgtaatcagcctcattggaccactggtcagaaatgtctgcgttttgtcacgttatccattgtaaattttcattctgttttgcatgtcagttagcattatgtaaacatttacaattaggttacattgttttaagaactaagtagcataagtgaagcatgatccaaaatacttgattattgcattttcagagcataaaccatgattaaaactgctactggcatcagaattgaaaatcatatgtttaagtaaatgttaggtacagattacaaaaatctgttaaagcaaaacattttggaggagtgaaatagtaaaatgccaagtattgtggcagatttatgctctgaaccacacaaaaaaattgaggaagcatttttttaaacagtcggtttaaattgtttttagaattattgctttttgttctaattttccacaaccattaatctcacttgtatatggcacacccagcacttgtgcctgtgggccatattagatgttcattgtcagagctcaagatgatatatataaatatatatatatatatatatatatatacacacacacacaaatgtctgtgcaagtaagaaaaaaaaagcatattctttgtgccttgtattttggggaaactctaaaactggtaatattttgtatgatgaaaaccctaatgagaaaaaacaagatatatagatggaaaaattatggggtttaaatgtttttttgttccaactctttttcagattttttgaatgtatataggactatgttgaaatgtagatatatgccacagagtctgtgtattgtataaaaaacaaaacaaaaaacaacaaaaaaaagatggctctagaaaactcatatttcggtacttgaccggaagaagacaaatacttgcacattattgcgattgttttattttttgtaccaaagacaaatgcaactgatatggcaaactgccagtctaagtaaagttttgcacagcttacatgatactgtatgaatgtatgaaaaaaaaggagaaaaaaaagaaaaaaaaaggtcagggttagggatcttactgaactgtgaattttatttctgtttgggtccaattatctacagaaggagcatccatacatacaaatattattttgctgttcctctagttcgcttccatagtagataagttggtggccatttagatgtcttttatttctgcacttattgtaggaaattttaatatatttcattttagtaagctattgataaaatagtttttgactttgaaaattaaaatgtttatttagcttattgtagtatacttccaccagacaacaaaatagattatttttattgtattatgtatatatatatatgtaaagaaagaaaaaagctaaaaatatctaattctttagttgccacttttccgattgatgtattattgtgcatgtaatattttcaaagatcaacacaggctaaaacaaaaacaatttatagatttttatatttttgtacaggtattttcaaactagcttcttcaaacttaacatgtgacttattcttctatagtttctagaattgagaaacattaacacatttagtttttaggtgctcttttttgctcatataaaacagcttcattagtcagtgttttaactgtgttcaagctttacctcttgatgagaaatttcttatgtcaaggcagcattataaaccttcccccacagatttttccatcctgtctctcttactgttttattctcaaatcttgtgctttgaactctgaaaactggtggcttaaaaactaaaaaaagaaaaaaagcatatttagcaaggaaaaaaataccaaaaatttcaggcatagctgctggaaaaattatctatttctccattacccactgtaggatttcttttttaattatactttgactataaagtgtcaaagtataatttgttcttttcttttactttgttaccccatttgtaagctatagcatatgaagctatatatatagcttgtgaaggtttgatctagaacacccagtaacaaatgaacaatgttgcttacctgcttctttgacatcttaaaaaagaaatccaaggaggattgtaaggattgtcttaccaccttagctgaactgtgatgcacaagatttttctatgtgtttggtggaaatgtacctggtttgtacattcacgctaaacagatgataagctcaagtctgatggtttaatagaatgtaagttcatcgtttaaagcttttcctttttaggttggagaaggaaccaggtgcagtggagntattaagcttgcccaggctcctgttcatgaaggttcccccagcggtggccggggaaccccgtatttgggagaggtaaagcccccacccggaaagttgaa

SEQ ID NO: 361942 - DNA, 1664 bp, Homo sapiens
cgccatcttgcttggagacactcgagagcggaagtagcgactgagcgcgtgcagtgggcgtgcttttctccagggagcgtcgcaaaggaggcgccggagtagggggacgcaattacacagtgaaacttggtgttcccggctagtcattcaaatcgaagctgtcgcagacctctgaacgttagtaacgcaacatgtgtttctccgcgactacagacctcgggagaggagcggtgggcaacgtgtctgtgctcggtcgaatgcgcacactccagttaggccgctggctcggacctagaaatgtttccgctttccttagtgcctgccccgcccaggccccgccccttgggccccgcccgacggctcgggagcgcgcgcggtcgcgtgcgggagggggcgggtggggaaggatcgcaggcgagattacgaggcgaggctcgcgcgcccgcccccgccctggcccccagtgcccacccggtcggcccggcacagccatgatcaaggcgatcctaatcttcaacaaccacgggaagccgcggctctccaagttctaccagccctacagtgaagatacacaacagcaaatcatcagggagactttccatttggtatctaagagagatgaaaatgtttgtaatttcctagaaggaggattattaattggaggatctgacaacaaactgatttatagacattatgcaacgttatattttgtcttctgtgtggattcttcagaaagtgaacttggcattttagatctaattcaagtatttgtggaaacattagacaaatgttttgaaaatgtctgtgagctggatttgattttccatgtagacaaggttcacaatattcttgcagaaatggtgatggggggaatggtattggagacaaatatgaatgagattgttacacaaattgatgcacaaaataagctggaaaaatctgaggctggcttagcaggagctccagcccgtgctgtatcagctgtaaagaatatgaatcttcctgagatcccaagaaatattaacattggtgacatcagtataaaagtgccaaacctgccctcttttaaataaaaatgtaaaaaggccactcccaggtaaaatccagggggaagagtcatctaagtttaccatgcagttgtttaccaaaaatagaggaggagagtcttaacttttgctcttggatttaagtcaaggtactgtatagaagttgtgtaaaatcagtatgaaagttcaatgttgctgttcttgctcagtgattttaaagaaattgagtagttcctatgtgatttttttttttcttttctaaactgcattcctgtgcccacctacggcatgcctctatgtattggctactacagtgttttaaaaagtgtttcagatatttctctaattatgtacaacctaaaatgttggtgttttgtatggatcacaagtgcagcattccttaattccttctgctatatgtcacacagttgttatttggagaaccaagtatgtattgcatgaaaacattatgacttttttctcttagtttaaataaactccaaggtaactggacttctaaagcacctttctgtttgcctgatatctactttagcaataattttttttacaaccctctgactcaacaaagtaaataaaagtatattttatcactattaa

SEQ ID NO: 361943 - DNA, 598 bp, Homo sapiens
aaagatggtaaacctctttgaattggattcttctttgatcccaacccactctaaattttggtagctagacctttaacttgaaacgatcaaattaaagaccctttcaaatattatacatgctgccttaattattatttagttgtatctccaacatctttgggggagcaggaaggaagggggggtaacaaaaacttcattgcttcaggtaggtataagtatagaggtcaatcacatttttagttgtacatcaaaaataactaacatccattaaattataaaacttctccagccctattcactatttaattgggtatggagttattcatttgtatcactcttatcattgcctgtgtagaatatacttattattaatactattctactaatttttctattatttccaattctgaattgataatccatggcttttatttcattgcttaacaatgtttgtatcctttatttagcaaatagtttacactggcctattttgtatcagtcaagatttttctcaggtaacagctttattattatttttattttaattaacaaaggtaggattacataagaaaagaaaactaaaattatgaaaagggac

SEQ ID NO: 361944 - DNA, 524 bp, Homo sapiens
  misc_feature (484)..(484): n is a, c, g, or t
gttcactgtattttttaatgtgtcactgttttctctttatagattagtatttcaaagtaaccattccataccaattcaaactaccatctggtccctaagcttgttatatgaaaatcttttatcattgtcttccattgtaagtgttttatgatgagctacacctgagttgtacattttctttttcttttatttgcttctgtatacagctggcttagcaggagctccagcccgtgctgtatcagctgtaaagaatatgaatcttcctgagatcccaagaaatattaacattggtgacatcagtataaaagtgccaaacctgccctcttttaaataaaaatgtaaaaaggccactcccaggtaaaatccagggggaagagtcatctaagtttaccatgcagttgtttaccaaaaatcacataggaactactcaatttctttaaaatcactgagcaagaacagcaacattgaactttcatactgattntacacaacttctatacagtgccttgacttaaatccaagag

SEQ ID NO: 361945 - DNA, 1700 bp, Homo sapiens
cgccatcttgcttggagacactcgagagcggaagtagcgactgagcgcgtgcagtgggcgtgcttttctccagggagcgtcgcaaaggaggcgccggagtagggggacgcaattacacagtgaaacttggtgttcccggctagtcattcaaatcgaagctgtcgcagacctctgaacgttagtaacgcaacatgtgtttctccgcgactacagacctcgggagaggagcggtgggcaacgtgtctgtgctcggtcgaatgcgcacactccagttaggccgctggctcggacctagaaatgtttccgctttccttagtgcctgccccgcccaggccccgccccttgggccccgcccgacggctcgggagcgcgcgcggtcgcgtgcgggagggggcgggtggggaaggatcgcaggcgagattacgaggcgaggctcgcgcgcccgcccccgccctggcccccagtgcccacccggtcggcccggcacagccatgatcaaggcgatcctaatcttcaacaaccacgggaagccgcggctctccaagttctaccagccctacggtatataactgggagtaaaattgccaaatcatatgagtgaagatacacaacagcaaatcatcagggagactttccatttggtatctaagagagatgaaaatgtttgtaatttcctagaaggaggattattaattggaggatctgacaacaaactgatttatagacattatgcaacgttatattttgtcttctgtgtggattcttcagaaagtgaacttggcattttagatctaattcaagtatttgtggaaacattagacaaatgttttgaaaatgtctgtgagctggatttgattttccatgtagacaaggttcacaatattcttgcagaaatggtgatggggggaatggtattggagacaaatatgaatgagattgttacacaaattgatgcacaaaataagctggaaaaatctgaggctggcttagcaggagctccagcccgtgctgtatcagctgtaaagaatatgaatcttcctgagatcccaagaaatattaacattggtgacatcagtataaaagtgccaaacctgccctcttttaaataaaaatgtaaaaaggccactcccaggtaaaatccagggggaagagtcatctaagtttaccatgcagttgtttaccaaaaatagaggaggagagtcttaacttttgctcttggatttaagtcaaggtactgtatagaagttgtgtaaaatcagtatgaaagttcaatgttgctgttcttgctcagtgattttaaagaaattgagtagttcctatgtgatttttttttttcttttctaaactgcattcctgtgcccacctacggcatgcctctatgtattggctactacagtgttttaaaaagtgtttcagatatttctctaattatgtacaacctaaaatgttggtgttttgtatggatcacaagtgcagcattccttaattccttctgctatatgtcacacagttgttatttggagaaccaagtatgtattgcatgaaaacattatgacttttttctcttagtttaaataaactccaaggtaactggacttctaaagcacctttctgtttgcctgatatctactttagcaataattttttttacaaccctctgactcaacaaagtaaataaaagtatattttatcactattaa

SEQ ID NO: 361946 - DNA, 1552 bp, Homo sapiens
cgccatcttgcttggagacactcgagagcggaagtagcgactgagcgcgtgcagtgggcgtgcttttctccagggagcgtcgcaaaggaggcgccggagtagggggacgcaattacacagtgaaacttggtgttcccggctagtcattcaaatcgaagctgtcgcagacctctgaacgttagtaacgcaacatgtgtttctccgcgactacagacctcgggagaggagcggtgggcaacgtgtctgtgctcggtcgaatgcgcacactccagttaggccgctggctcggacctagaaatgtttccgctttccttagtgcctgccccgcccaggccccgccccttgggccccgcccgacggctcgggagcgcgcgcggtcgcgtgcgggagggggcgggtggggaaggatcgcaggcgagattacgaggcgaggctcgcgcgcccgcccccgccctggcccccagtgcccacccggtcggcccggcacagccatgatcaaggcgatcctaatcttcaacaaccacgggaagccgcggctctccaagttctaccagccctacagtgaagatacacaacagcaaatcatcagggagactttccatttggtatctaagagagatgaaaatgtttgtaatttcctagaaggaggattgtatttgtggaaacattagacaaatgttttgaaaatgtctgtgagctggatttgattttccatgtagacaaggttcacaatattcttgcagaaatggtgatggggggaatggtattggagacaaatatgaatgagattgttacacaaattgatgcacaaaataagctggaaaaatctgaggctggcttagcaggagctccagcccgtgctgtatcagctgtaaagaatatgaatcttcctgagatcccaagaaatattaacattggtgacatcagtataaaagtgccaaacctgccctcttttaaataaaaatgtaaaaaggccactcccaggtaaaatccagggggaagagtcatctaagtttaccatgcagttgtttaccaaaaatagaggaggagagtcttaacttttgctcttggatttaagtcaaggtactgtatagaagttgtgtaaaatcagtatgaaagttcaatgttgctgttcttgctcagtgattttaaagaaattgagtagttcctatgtgatttttttttttcttttctaaactgcattcctgtgcccacctacggcatgcctctatgtattggctactacagtgttttaaaaagtgtttcagatatttctctaattatgtacaacctaaaatgttggtgttttgtatggatcacaagtgcagcattccttaattccttctgctatatgtcacacagttgttatttggagaaccaagtatgtattgcatgaaaacattatgacttttttctcttagtttaaataaactccaaggtaactggacttctaaagcacctttctgtttgcctgatatctactttagcaataattttttttacaaccctctgactcaacaaagtaaataaaagtatattttatcactattaa

SEQ ID NO: 361947 - DNA, 1705 bp, Homo sapiens
cgccatcttgcttggagacactcgagagcggaagtagcgactgagcgcgtgcagtgggcgtgcttttctccagggagcgtcgcaaaggaggcgccggagtagggggacgcaattacacagtgaaacttggtgttcccggctagtcattcaaatcgaagctgtcgcagacctctgaacgttagtaacgcaacatgtgtttctccgcgactacagacctcgggagaggagcggtgggcaacgtgtctgtgctcggtcgaatgcgcacactccagttaggccgctggctcggacctagaaatgtttccgctttccttagtgcctgccccgcccaggccccgccccttgggccccgcccgacggctcgggagcgcgcgcggtcgcgtgcgggagggggcgggtggggaaggatcgcaggcgagattacgaggcgaggctcgcgcgcccgcccccgccctggcccccagtgcccacccggtcggcccggcacagccatgatcaaggcgatcctaatcttcaacaaccacgggaagccgcggctctccaagttctaccagccctacagtgaagatacacaacagcaaatcatcagggagactttccatttggtatctaagagagatgaaaatgtttgtaatttcctagaaggaggattattaattggaggatctgacaacaaactgatttatagacattatgcaacgttatattttgtcttctgtgtggattcttcagaaagtgaacttggcattttagatctaattcaagtatttgtggaaacattagacaaatgttttgaaaatgtctgtgagctggatttgattttccatgtagacaaggttcacaatattcttgcagaaatggtgatggggggaatggtattggagacaaatatgaatgagattgttacacaaattgatgcacaaaataagctggaaaaatctgagacctttatctttcagtctcccagacaggacaggtagacaaggctggcttagcaggagctccagcccgtgctgtatcagctgtaaagaatatgaatcttcctgagatcccaagaaatattaacattggtgacatcagtataaaagtgccaaacctgccctcttttaaataaaaatgtaaaaaggccactcccaggtaaaatccagggggaagagtcatctaagtttaccatgcagttgtttaccaaaaatagaggaggagagtcttaacttttgctcttggatttaagtcaaggtactgtatagaagttgtgtaaaatcagtatgaaagttcaatgttgctgttcttgctcagtgattttaaagaaattgagtagttcctatgtgatttttttttttcttttctaaactgcattcctgtgcccacctacggcatgcctctatgtattggctactacagtgttttaaaaagtgtttcagatatttctctaattatgtacaacctaaaatgttggtgttttgtatggatcacaagtgcagcattccttaattccttctgctatatgtcacacagttgttatttggagaaccaagtatgtattgcatgaaaacattatgacttttttctcttagtttaaataaactccaaggtaactggacttctaaagcacctttctgtttgcctgatatctactttagcaataattttttttacaaccctctgactcaacaaagtaaataaaagtatattttatcactattaa

SEQ ID NO: 361948 - DNA, 925 bp, Homo sapiens
gttcactgtattttttaatgtgtcactgttttctctttatagattagtatttcaaagtaaccattccataccaattcaaactaccatctggtccctaagcttgttatatgaaaatcttttatcattgtcttccattgtaagtgttttatgatgagctacacctgagttgtacattttctttttcttttatttgcttctgtatacagctggcttagcaggagctccagcccgtgctgtatcagctgtaaagaatatgaatcttcctgagatcccaagaaatattaacattggtgacatcagtataaaagtgccaaacctgccctcttttaaataaaaatgtaaaaaggccactcccaggtaaaatccagggggaagagtcatctaagtttaccatgcagttgtttaccaaaaatagaggaggagagtcttaacttttgctcttggatttaagtcaaggtactgtatagaagttgtgtaaaatcagtatgaaagttcaatgttgctgttcttgctcagtgattttaaagaaattgagtagttcctatgtgatttttttttttcttttctaaactgcattcctgtgcccacctacggcatgcctctatgtattggctactacagtgttttaaaaagtgtttcagatatttctctaattatgtacaacctaaaatgttggtgttttgtatggatcacaagtgcagcattccttaattccttctgctatatgtcacacagttgttatttggagaaccaagtatgtattgcatgaaaacattatgacttttttctcttagtttaaataaactccaaggtaactggacttctaaagcacctttctgtttgcctgatatctactttagcaataattttttttacaaccctctgactcaacaaagtaaataaaagtatattttatcactattaa

SEQ ID NO: 361949 - DNA, 358 bp, Homo sapiens
agatctgttagcttttatgtatttcatgttattcttaagatggataaatgggtctgaatttagtcactactttttgaaagtcagtcctcttttttttccgaacatcctgatctttctagctctttccattcttctctcttacagacctttatctttcagtctcccagacaggacaggtagacaaggtattgctgactttgagaaatatgtactataacaaagggaaagcaaaatgatgtcaaaggcaattaattatttaggccagactcaaaaattctttgtgttaataaacccatatagtccctgtagcctattttccattctagtttctccttgtagtttcttcatcttttattgg

SEQ ID NO: 361950 - DNA, 2244 bp, Homo sapiens
cgccatcttgcttggagacactcgagagcggaagtagcgactgagcgcgtgcagtgggcgtgcttttctccagggagcgtcgcaaaggaggcgccggagtagggggacgcaattacacagtgaaacttggtgttcccggctagtcattcaaatcgaagctgtcgcagacctctgaacgttagtaacgcaacatgtgtttctccgcgactacagacctcgggagaggagcggtgggcaacgtgtctgtgctcggtcgaatgcgcacactccagttaggccgctggctcggacctagaaatgtttccgctttccttagtgcctgccccgcccaggccccgccccttgggccccgcccgacggctcgggagcgcgcgcggtcgcgtgcgggagggggcgggtggggaaggatcgcaggcgagattacgaggcgaggctcgcgcgcccgcccccgccctggcccccagtgcccacccggtcggcccggcacagccatgatcaaggcgatcctaatcttcaacaaccacgggaagccgcggctctccaagttctaccagccctacagtgaagatacacaacagcaaatcatcagggagactttccatttggtatctaagagagatgaaaatgtttgtaatttcctagaaggaggattattaattggaggatctgacaacaaactgatttatagacattatgcaacgttatattttgtcttctgtgtggattcttcagaaagtgaacttggcattttagatctaattcaagtatttgtggaaacattagacaaatgttttgaaaatgtctgtgagctggatttgattttccatgtagacaaggttcacaatattcttgcagaaatggtgatggggggaatggtattggagacaaatatgaatgagattgttacacaaattgatgcacaaaataagctggaaaaatctgaggctggcttagcaggagctccagcccgtgctgtatcagctgtaaagaatatgaatcttcctgagatcccaagaaatattaacattggtgacatcagtataaaagtgccaaacctgccctcttttaaataaaaatgtaaaaaggccactcccaggtaaaatccagggggaagagtcatctaagtttaccatgcagttgtttaccaaaaatagaggaggagagtcttaacttttgctcttggatttaagtcaaggtactgtatagaagttgtgtaaaatcagtatgaaagttcaatgttgctgttcttgctcagtgattttaaagaaattgagtagttcctatgtgatttttttttttcttttctaaactgcattcctgtgcccacctacggcatgcctctatgtattggctactacagtgttttaaaaagtgtttcagatatttctctaattatgtacaacctaaaatgttggtgttttgtatggatcacaagtgcagcattccttaattccttctgctatatgtcacacagttgttatttggagaaccaagtatgtattgcatgaaaacattatgacttttttctcttagtttaaataaactccaaggtaactggacttctaaagcacctttctgtttgcctgatatctactttagcaataattttttttacaaccctctgactcaacaaagtaaataaaagtatattttatcactattaaaaaaaaaaaaaaaaaaaaaaaaaaaaaaaaaaaaaaaaaaaaaaaaaagagggggggggccaaaaaaagacccccgggggggcccccagggaggggccacccttgtgggaaagagggggccccaaaggggggcgcgccgtaaaaattaaagcacgaggacgggcgcccgccatcgttaaaaacacaactgctgcatgacccgtcgggaaacaacagtgcgaggaccaccgtggggaccaccttccgtgggaggaagcaccccccaacctacgtgggggagggggagaacacaactattgggggaagacaaccactccccttacaaaggagagattatacaacagccccccaaggggaggaagaacatacaaacactctcagaggcgaggatcatcgggggtgcacccaaccgcgacgaatactcggccgacgcgattgaaacaattatgacgcccacgagagacaatatctatgcgagccaaactttaccagcggagcagagtcaaaacaacacgcgacactacatctacgaaactgataccaatcacacatcgacacaccgcacacccgagcgagcaac

SEQ ID NO: 361951 - DNA, 1599 bp, Homo sapiens
cgccatcttgcttggagacactcgagagcggaagtagcgactgagcgcgtgcagtgggcgtgcttttctccagggagcgtcgcaaaggaggcgccggagtagggggacgcaattacacagtgaaacttggtgttcccggctagtcattcaaatcgaagctgtcgcagacctctgaacgttagtaacgcaacatgtgtttctccgcgactacagacctcgggagaggagcggtgggcaacgtgtctgtgctcggtcgaatgcgcacactccagttaggccgctggctcggacctagaaatgtttccgctttccttagtgcctgccccgcccaggccccgccccttgggccccgcccgacggctcgggagcgcgcgcggtcgcgtgcgggagggggcgggtggggaaggatcgcaggcgagattacgaggcgaggctcgcgcgcccgcccccgccctggcccccagtgcccacccggtcggcccggcacagccatgatcaaggcgatcctaatcttcaacaaccacgggaagccgcggctctccaagttctaccagccctacagtgaagatacacaacagcaaatcatcagggagactttccatttggtatctaagagagatgaaaatgtttgtaatttcctagaaggaggattattaattggaggatctgacaacaaactgatttatagacattatgcaacgttatattttgtcttctgtgtggattcttcagaaagtgaacttggcattttagatctaattcaagtatttgtggaaacattagacaaatgttttgaaaatgtctgtgagctggatttgattttccatgtagacaaggttcacaatattcttgcagaaatggtgatggggggaatggtattggagacaaatatgaatgagattgttacacaaattgatgcacaaaataagctggaaaaatctgaggctggcttagcaggagctccagcccgtgctgtatcagctgtaaagaatatgaatcttcctgagatcccaagaaatattaacattggtgacatcagtataaaagtgccaaacctgccctcttttaaataaaaatgtaaaaaggccactcccaggtaaaatccagggggaagagtcatctaagtttaccatgcagttgtttaccaaaaatagaggaggagagtcttaacttttgctcttggatttaagtcaaggtactgtatagaagttgtgtaaaatcagtatgaaagttcaatgttgctgttcttgctcagtgattttaaagaaattgagtagttcctatgtgatttttttttttcttttctaaactgcattcctgtgcccacctacggcatgcctctatgtattggctactacagtgttttaaaaagtgtttcagatatttctctaattatgtacaacctaaaatgttggtgttttgtatggatcacaagtgcagcattccttaattccttctgctatatgtcacacagttgttatttggagaaccaagtatgtattgcatgaaaacattatgacttttttctcttagtttaaataaactccgatgcggcagatgttattctcgtttttttacaaaatgggaaatagtcactaa

SEQ ID NO: 361952 - DNA, 1753 bp, Homo sapiens
cgccatcttgcttggagacactcgagagcggaagtagcgactgagcgcgtgcagtgggcgtgcttttctccagggagcgtcgcaaaggaggcgccggagtagggggacgcaattacacagtgaaacttggtgttcccggctagtcattcaaatcgaagctgtcgcagacctctgaacgttagtaacgcaacatgtgtttctccgcgactacagacctcgggagaggagcggtgggcaacgtgtctgtgctcggtcgaatgcgcacactccagttaggccgctggctcggacctagaaatgtttccgctttccttagtgcctgccccgcccaggccccgccccttgggccccgcccgacggctcgggagcgcgcgcggtcgcgtgcgggagggggcgggtggggaaggatcgcaggcgagattacgaggcgaggctcgcgcgcccgcccccgccctggcccccagtgcccacccggtcggcccggcacagccatgatcaaggcgatcctaatcttcaacaaccacgggaagccgcggctctccaagttctaccagccctacagtgaagatacacaacagcaaatcatcagggagactttccatttggtatctaagagagatgaaaatgtttgtaatttcctagaaggaggattattaattggaggatctgacaacaaactgatttatagacattatgcaacgttatattttgtcttctgtgtggattcttcagaaagtgaacttggcattttagatctaattcaagtatttgtggaaacattagacaaatgttttgaaaatgtctgtgagctggatttgattttccatgtagacaaggttcacaatattcttgcagaaatggtgatggggggaatggtattggagacaaatatgaatgagattgttacacaaattgatgcacaaaataagctggaaaaatctgagacctttatctttcagtctcccagacaggacaggtagacaagcaaatagtttacactggcctattttgtatcagtcaagatttttctcaggctggcttagcaggagctccagcccgtgctgtatcagctgtaaagaatatgaatcttcctgagatcccaagaaatattaacattggtgacatcagtataaaagtgccaaacctgccctcttttaaataaaaatgtaaaaaggccactcccaggtaaaatccagggggaagagtcatctaagtttaccatgcagttgtttaccaaaaatagaggaggagagtcttaacttttgctcttggatttaagtcaaggtactgtatagaagttgtgtaaaatcagtatgaaagttcaatgttgctgttcttgctcagtgattttaaagaaattgagtagttcctatgtgatttttttttttcttttctaaactgcattcctgtgcccacctacggcatgcctctatgtattggctactacagtgttttaaaaagtgtttcagatatttctctaattatgtacaacctaaaatgttggtgttttgtatggatcacaagtgcagcattccttaattccttctgctatatgtcacacagttgttatttggagaaccaagtatgtattgcatgaaaacattatgacttttttctcttagtttaaataaactccaaggtaactggacttctaaagcacctttctgtttgcctgatatctactttagcaataattttttttacaaccctctgactcaacaaagtaaataaaagtatattttatcactattaa

SEQ ID NO: 361953 - DNA, 840 bp, Homo sapiens
ctgaggtgggagcatcacttaggtccaggagttcaaggctgcagtgagctatgatcacgttactgcactccagcttaggcaacagagcaaaaccctgcctccattaaaaataaacataaaacaaattaaaaaaaatgtagtgtctactatatgctagtacagcagtgagtaagagagaccagaacctgtccttagagagcttatcattctggcaggaacactcaacattactaatgaaaaagtctgggttctttgattgaaatcacataaagagtagagcactttaaaacacaaaacagttatctgccctccttgttaacagctactatggatcagagaacccatactcatcagcacattcccaaaataccctaagagcttgaggtcaacttggttttacctgtctggacacaggtaaaccaatcctcttctaaaaattattcaaataaatctccttttcttgctttaagttatccttctcataactggacaatgaaacaacccaattagatactccctggttgagaaacaattttatggagagatttatattcagtgaggttttgacaacacactttttctgcgtgattgggaagtttctacagacagaaatcaatcaagctgaaacagtttaaaatgcctaaaatgcacttctaaactcaagaagaggtcatggatagacgctagccaagacagtacaaaaagtctcccaaaaatttaaccttggctgggcacggtggctcacgcctgtaatcctagtgctttgggagactgaggcaggacagcttgagaccagggagctaaaaccagcctgagcaacgtagaagaccctgtctctaa

SEQ ID NO: 361954 - DNA, 326 bp, Homo sapiens
gtcttcagatgttgccagaagtcccttggggaacaacatagcccccacttgagaaccactgatctaatcccttcaaatcaccgtagggatctctgggggattttgcagtggtctcgggaaaatgcacagacatgtcgtattaggaaggggtagttttgggtaattgcaaggtagttgaggacatttaagggaattgtacaaggcataaagatgtcaggcttctgaagtttttttttttttttttttgagatggagtctcactctgtcaccaggctggagtgcagtggtttaatcttggctcactgcaacccctgcctcccgggttc

SEQ ID NO: 361955 - DNA, 2205 bp, Homo sapiens
  misc_feature (1683)..(1683): n is a, c, g, or t
  misc_feature (2123)..(2123): n is a, c, g, or t
  misc_feature (2204)..(2204): n is a, c, g, or t
tgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtaagaaagtagctttgtatacaaacattctttaccttttctgtcttaattgttggtttaaaaaaaaaaagttactcggtgaatacaaatatattgctttgggcttggtcctgataaaggctagttaacttccaagtaaacattcagcctttattctagccaccaatttcttaaatatttagaattgttctcaaaaggaactgtatgagagactggacacttccatggactagttactcctctgtaaaaactaagagtatttattttaccagtgctggattaccagtgtcatcttcatatatgaagaagattaaaattttattgaaacataaaacataattgatttggtaatagtggaaataaacgataccatcaagatatgattaaataatttaaaatctatttgttaattgatggaaaacttcaaacatgcataagaagttactgtacttatcactcagtttcaataatttatcaattcattgctaaagttctttcatgtaataccctcgcccatttcttccctttctatattactttgaagcaaatacgtattgtttctacttgtaatgtagttagtgttttatatacttttatgtaatattattacattttaattgatatcttatgttttttattttattttattttattttcctgagacagggtctcactctgtcacacaggctggactgcagtggcatcatcttggttcactgcaacctctgcctcccaggctcaagtgatcctcccacctcagcctcctcagtagntgggactacaggtgcataccaccacacccggctaatttttgtatttttagtagagacagggttttgctgtgttgcccagctggcctcgaactcctgagcccaagcgatacacctgccttggcctcccagagtgctgagattacagatgtgagccactgtgttcagctgataagtgtttaaatttctctaaaaactatttacttataaaggtaaaaaagatctctttaggcttcagtttcacatatctcctttaatctttttttaataatttctagtgatgggatgattaagagactattaaagctattacctctttagagtcatgttcaaaataattattagatctgaaaagggacttgtgggttttgttgttgttgtttatccttctgcttctccaatttgtgttgtaaattcatgtttaattttgtgttccctcattncagtttatcaaagtacattctgtatattttctgtggtttttttccttcagttttaatattaaattattggattcttttttnc

SEQ ID NO: 361956 - DNA, 409 bp, Homo sapiens
  misc_feature (29)..(29): n is a, c, g, or t
aaatgagcaaggaagatctacaaccggtnattaaaaaaaaaagaaaccttgcgggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactatt

SEQ ID NO: 361957 - DNA, 3480 bp, Homo sapiens
tgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaacgatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgatgtttaaatcaccagataagtattggtgacttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactatt

SEQ ID NO: 361958 - DNA, 3568 bp, Homo sapiens
tgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaacgatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgatgtttaaatcaccagataagtattggtgacttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaagacacttaatataaacacaaaatattatgttctggtgatctaatccagcagaaaatgagagtgaaattatacctccaatcatatacagatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactatt

SEQ ID NO: 361959 - DNA, 3363 bp, Homo sapiens
tgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaacgatgaaataaaaaagatccaagatctcctcatgagctttggtatccttaaacctgacttaaggattgtctttgtacataacaagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgatgtttaaatcaccagataagtattggtgacttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactatt

SEQ ID NO: 361960 - DNA, 3806 bp, Homo sapiens
tgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaacgatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgatgtttaaatcaccagataagtattggtgacttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactattaaaaaagaagaaaaaaaattggtcctctttggcctttagacggtggatgctttgcggccggttccttttactgagggtttatttattgatccctggttacttgctctgctgggccccgtcgtgtagtttgctgtaaacgtaatcagtatcatttacggccgttattttagcttctccctcttgccggtgctaatttctgatacttcttttctgttcacattgccttcactctgctttattaccacttatatgtcttgcctcttattgttcctcattaccctctcccctttgacctctctttattaagttgtttttttatgtttagg

SEQ ID NO: 361961 - DNA, 3839 bp, Homo sapiens
tgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaacgatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgatgtttaaatcaccagataagtattggtgacttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactattaaaaaaaaaaaacaaaacacaaaacatgtgccgggcggcctatgggcccttggaaaacagtttacaagaaccattccgatggggcgacggagccccagcaggcagcgggaccacgggccaatagggggtaccccaaggagaaccggggcccagtgacaaaagcgggccgtggggaatttcctgcaccgcagtgaaagaaaagggccgaggggggacaaacccgagaaggcgtgtcacgtgagaaccaaatccccgaagaggggccgttacccgagaagggcacaataaacggggggaatctaaacacaaaacgagggaaagtccacaggggagacgccccaaatatcctcaaataagcc

SEQ ID NO: 361962 - DNA, 3508 bp, Homo sapiens
tgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaacgatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgatgtttaaatcaccagataagtattggtgacttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactattatttgattctcaagaaccaaccatcatc

SEQ ID NO: 361963 - DNA, 1269 bp, Homo sapiens
tcagctgagtctagttgcatcatgattagtgagaaggtagagcaaaaatgatacaacacccaagaatcgtactagctaccatttctcttcctgtctttatcttggagttctgtccatgatcctaaattctctaagatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactatt

SEQ ID NO: 361964 - DNA, 2863 bp, Homo sapiens
tgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaacgatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgatgtttaaatcaccagataagtattggtgacttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaagagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactatt

SEQ ID NO: 361965 - DNA, 705 bp, Homo sapiens
gtaaacccccttattttgtgtttttaataagttaaagggccataatttctttttcagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactatt

SEQ ID NO: 361966 - DNA, 628 bp, Homo sapiens
aatactgacttcttgagtttagtaaatctaaattgtattaaaagttatctatatcatttttgtccctaggcagttatttggcagaaaagcagagtatcagatcacaagatggctctcatgtcagttctggggactgctgttatgaacaatatggaatcctttcagtaccactctgaagaatctcaggtatactgcaaaaacattctcagataattctgatttactcatgaagctgttcacatatttccctttgggggagttacagtggcaagaggttagtcttttaatattttaatcaaatatgtgtgtaaggtaaaacagtcaatacagagcttatgttaaacctctttccccagccctgcttccctttttatcttttctgtttgttgcttacattgattttcaaaaaaattatgttcaatttagaatcttttctgtttactttctactataaaagaaaaatagttggctgggcatggtgactcatgcctgtaattccagcactttggaagtccggggcaggcagatgacgtgaggtcaggacttcaagaccagcctggccaacatggtgaaaccctgtctctactaaaaatacaaaaattagccaggtgtggtggcacatgcctgt

SEQ ID NO: 361967 - DNA, 573 bp, Homo sapiens
  misc_feature (33)..(35): n is a, c, g, or t
  misc_feature (37)..(38): n is a, c, g, or t
cgcggcgccgcccggccgccggcccgtctttgnnngnngttctgtggatacaccccgagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactatt

SEQ ID NO: 361968 - DNA, 3657 bp, Homo sapiens
tgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaaggtagtgtggtgtgactaacgggtatttattatatcctcgatggctcgagggccccgtcccctctactcgtcctggtccgggcgcgaacgctatagggcagctaagggcgctccccgcggggcgggaagcgaagccgggcttgcgggcgcgcacacgtggaacgcgttttctgagcagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaacgatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgatgtttaaatcaccagataagtattggtgacttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactatt

SEQ ID NO: 361969 - DNA, 3606 bp, Homo sapiens
tgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaaggcacacctgttgtccttaactgactttccgggtcatcagcacttcttcagaagtgttccttttccctcccagcaaatatggaagactgactatcctgatattcccagacattctttgctgtgatttctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaacgatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgatgtttaaatcaccagataagtattggtgacttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactatt

SEQ ID NO: 361970 - DNA, 2448 bp, Homo sapiens
tgtcgttagtgatgaatgcagaggaaagcagctcggctaattgcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgatgtttaaatcaccagataagtattggtgacttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactatt

SEQ ID NO: 361971 - DNA, 3349 bp, Homo sapiens
tgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaacgatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgatgtttaaatcaccagataagtattggtgacttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactatt

SEQ ID NO: 361972 - DNA, 1170 bp, Homo sapiens
tcagctgagtctagttgcatcatgattagtgagaagatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactatt

SEQ ID NO: 361973 - DNA, 1156 bp, Homo sapiens
tcagctgagtctagttgcatcatgattagtgagaaggtagagcaaaaatgatacaacacccaagaatcgtactagctaccatttctcttcctgtctttatcttggagttctgtccatgatcctaaattctctaagatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactatt

SEQ ID NO: 361974 - DNA, 11405 bp, Homo sapiens
gcggccgctcccccggagcggctaaagcggcggcgaccgaggcgagcaatgggcacggcagtctcggcagagcacaggcgcttcaccgcggctgctcgggctccgcgctgacctgcccgggcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 361975 - DNA, 1741 bp, Homo sapiens
gtggtcaccttccccagctagaaagccttctttttatatcaacttccttttaattatgaagtattacaatcaagcataaagacataataaatgttaacatctttcctttgtgtctgtttaaaaaatgtttcttattacagaaaatttcaaatagatttaaagtagagaaatgcacgtgatgaaaccccatgcacttgccattccatttcaatagttattacttcacggaagagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctttccgggaatggatggaggtgctttaactgatgcgagtctcacagagtcctatttcagcaccagctttattggagtcaatggatttggaagccctgtagaaacaaagtatcccttgatgcagtacactctggttgtcttccaacgtcttcgggtctgcacctctggattcagcaataccaaaaacaccggcccccaaacttcccacctacttgaaccaataaacttcctcttgtgtttaaact

SEQ ID NO: 361976 - DNA, 2912 bp, Homo sapiens
  misc_feature (1367)..(1367): n is a, c, g, or t
ggctctttttaacatgaggtcactgaaaatccataattaaaacattaaaaatgggccaggcggtagctcacgcctgtaatccaagcactttgggaggctgaggtgggaggattgtgtgaagccaggagttcaaaatcagcctgggcaacatagcaagaccccatctctacaaaaaaatttgaaaaatagccaggcgtggtggcatgtgcctttagtcccagcttactctagaggctgaggcaggaagattgcgtgagctcaggagttcaaggctgcagtgagctatcatcacaccactcagagcaagactgtctccaaaacagacaagtgaacaagaaaacattagtgacggatctaaggaaacttagccaagttttgataacggaacctgggcgttgtggcatactctataaaaagccattcagcagccttcatctaccttttattctgcttcacttttatttaacttctgtagccctttaaaaaaaatcaatcttcttgtttttatttagtataacagaagagaactataatttcctgccacatagcccctccaagaaagattctgaatggaagagtggaacaaaagtcagtcgtacattcagctacatcaagaataaaatgtctagcagcaagaagagcaaagtgagtatcactgtgggcattgcttgtgatcacctcagtaggatcctgtcacagcctgcattcacaccaaaactggttaaatcatggggacataaatggaaataaattcaggattactctccgaaatcgcctaatatttaaaggaaaataataagaagaaaaatagcaagaagtggaactaccagttactgagttttcactatatgctaagtgctttccatatattatttaaccctttcaacaaccctgtcaggtaggtgttatctctcttttctaaaagtgatgtaccttaccgaggatactcctctaatgtgaagaagtagttcaaaccagatctctttggtttcaaatcccatactcttaaaccacagtgcttaaatctgtaatatcagtttaaatgcaacagaaggattttatgcaaagatcaaaggattgaaaatatttatatttgggtttagagggaaggattatcccacagaagattacaagaacttttaagactaatatgatttcttagatctatttctaattaggagcatttggaatatattctcttagtgattaagagattaaataaatgtttaaaccgtgtgtgtgtgtgtgtgtgtgtgtgtctgtgtgtgtgtgtgtgtaaggctccactgtatcacccaggctggagcacagtggcgtgaccatagctcactgcagtcttgaactgccaggcttaagcagtttcctgnctcgcaccgtagcctcccgagtagccaggactacagtcatgttgtgccatcgtgctgagctatgtttaaatttgtttgtaaagatgaagtcttgctgttgtgtctaggccggtctaatgccttacctcaaacactcttctcgctgcaggcttccgaagccctgggtgtgatccaccgtgcccagcctaaagtaacattttttatctaattatttttcacatgctcattatggaaatcttcaaaatctaaaagtaaaagaatgaaaatctcctggaataaccccgcttagagataactacacttaatgttttggtttatatatttctaatcttttttaaaaatgtattttcaaaagaaagggagaaaagaagttcactttcttatactgattcccagtgctaaaccaaaactgattccatttcaagtccgtggggaaaaacttttcgcctctcacaccctgttcatctacccacaacaccctctaacaaaataaagacataagtaaataaaaatttgaaatcagttaaggaactcttgcaaggaatcactgtgtgtgtgtgtgtgtgtatgtgtgtgtgtgcacgtgcatgcatgtgtgtgtgtgtgtgtgtgtggtatatacatgtacatacagatatatacacacgtagatacatgcatatttagaagtaagggaataaacaaacattgaattcaagaatattgtcataaaagggcattgcctcctccctcacaaaacaaggtgcactaagcttctcaagccctcacttcagtgggctgatggaaatatagccaaagtattttaccatgttttgtaagatctcttggtttagcaaatacattcaaagaaatttttccaccaaacgtgccacaagaattgtgttttcatttctcctgtgcaagtacagaatggagagaaagtaggaatcagggagagatgcaaagagtctagcaaattatttctagcataatcacacatttaacttcagactcagccttgtattataattccaaaaaaaaaaaaaaatgagggtcaaagaatacggtttacccagtatcctacgtattaacatttgggcagccaggttaaaaatagagcctaacctatttaactaaccactgccggctgggatactagtgggtatcaacaaaagaaaatcccccttggacagagcaatataaattagccaagtattattaaatgccttgtatagtcttagcatcccactaggtgttaacaggcacctaagagaactaaagctcatagtcctgaccttgaaaaactttatgatctagttgggatgaattccaaaatgtttccatggttttttatttggctttaaaactactgaatcttgtcttcaaacaagcttttcgtggaagaccaataaataagtggagattccccctttctagccatctccccaatgtcatggagttttaggacagagcagtgaatgtaccacttatctcatggataaggtaaaacatacacatgataggaaaaaaacaacgtaagttggaatttagaaactggaccctgac

SEQ ID NO: 361977 - DNA, 663 bp, Homo sapiens
  misc_feature (21)..(21): n is a, c, g, or t
tgtaactgatacgactcgagntcggtacccggagacacttacgaatcagggagagatgcaaagagtctagcaaattatttctagcataatcacacatttaacttcagactcagccttgtattataattccaaaaaaaaaaaaaaatgagggtcaaagaatacggtttacccagtatcctacgtattaacatttgggcagccaggttaaaaatagagcctaacctatttaactaaccactgccggctgggatactagtgggtatcaacaaaagaaaatcccccttggacagagcaatataaattagccaagtattattaaatgccttgtatagtcttagcatcccactaggtgttaacaggcacctaagagaactaaagctcatagtcctgaccttgaaaaactttatgatctagttgggatgaattccaaaatgtttccatggttttttatttggctttaaaactactgaatcttgtcttcaaacaagcttttcgtggaagaccaataaataagtggagattccccctttctagccatctccccaatgtcatggagttttaggacagagcagtgaatgtaccacttatctcatggataaggtaaaacatacacatgataggaaaaaaacaacgtaagttggaatttagaaactggaccctgac

SEQ ID NO: 361978 - DNA, 653 bp, Homo sapiens
atacgactcgagctcgacccggagacacttacgaatcagggagagatgcaaagagtctagcaaattatttctagcataatcacacatttaacttcagactcagccttgtattataattccaaaaaaaaaaaaaaatgagggtcaaagaatacggtttacccagtatcctacgtattaacatttgggcagccaggttaaaaatagagcctaacctatttaactaaccactgccggctgggatactagtgggtatcaacaaaagaaaatcccccttggacagagcaatataaattagccaagtattattaaatgccttgtatagtcttagcatcccactaggtgttaacaggcacctaagagaactaaagctcatagtcctgaccttgaaaaactttatgatctagttgggatgaattccaaaatgtttccatggttttttatttggctttaaaactactgaatcttgtcttcaaacaagcttttcgtggaagaccaataaataagtggagattccccctttctagccatctccccaatgtcatggagttttaggacagagcagtgaatgtaccacttatctcatggataaggtaaaacatacacatgataggaaaaaaacaacgtaagttggaatttagaaactggaccctgac

SEQ ID NO: 361979 - DNA, 565 bp, Homo sapiens
taaattcgcggccgcgtcgactttttttttttttttctttgctcttcttgctgctagacattttattcttgatgtagctgaatgtacgactgacttttgttccactcttccattcagaatctttcttggaggggctatgtggcaggaaattatagttctcttctgttatactctcagtcagattagcactggtattgtggaaggtactgtggaagggccgtgaattgtccaatccaggatggctgattgtcattaatgagatggattttgtcaatggagaggaaatggctgatgtacagtaattaaatccctgctgcttagatctgtgacatatctgctgatcaaacatcctatgttctctctggtctgactccagatcctcttctgaaagtgacaccaaagagtcaacccgttcctcaccactgaatgggtgtctgagctcttcggcatttgcagagcttacttctagagatgaggatggcttgtttccgacaccagctcctcctgtcaagccttctagactgaaactccggtggttcatttctgcatcgctggctgcattttt

SEQ ID NO: 361980 - DNA, 781 bp, Homo sapiens
gcttctctattgaagtcgacgaattagtctactttcgtacctgaaaacccttcctggggagtactttttttttcttttccacaaaagaaaaaccaggaatgtgtgtgtgcttgtgcacaggccctaaagtattgtcaacacattgtttaataatgtaatgaaagactttattactaggccacctggcattttccattccattgtggatatagtcatttcttaaagcaagtcagaggcataagttcattccttggcctttgaattccttaattagtatttgtcaggtaatattttgaagctaaaaataaacgatttataagctgagaagtaatttctagtcagattgctaatttgcttcaaattttccgttggattttctttagaagtcattagtgaccttccattgtttagaaaaatatttagaaatccaaaaattagggttatattactgttagtttctcaggaggcatttgtaaagaagtatttttaactattagctgaacctgtttgttggcaagtgggcaaatagtgatctttcctactttgtctttttcaagtggatgctttctttaattccagattttaggcaagaaattgagctgaaattcagatattctcatgaatttcagataatcatgattcctatgaaattgttcttccagaaaataagttgttaaataagttttaaccccatctctactaaataagtttttcagtagaaggttctttggagatacgtttgtctgggtctttattaaagctcttcaatatgagcttatta

SEQ ID NO: 361981 - DNA, 675 bp, Homo sapiens
agatgtttttagtatacttttaaggaagagaaccccaggtatgaattgtgatcattcttattttcataatctaacaggtatgtatttattagccaaattttttagaaactgcattagaattctgtatattcagaaatggagatgagaatgtaaacaaattattacatcattcacctagacagcatttcccggaaccgcataggccattgacattatgctgtttccccatgtgctgaaggccctggcataatccgagcatgctctaatgtcttctgtgaacctccttctcagctcagcagcagatgcggccagcaaggcggatctccatcagcatctctccgctcctccttaagtctaaaactctcttttctcttggctcttcttattcgagtgatgaggaggaggagttgcatagtaagtaagcaactttggtgtccagtgactgttcttgaaggtctgaccagctcagatgctgtaggcttggtactaagaaattgtatgggggcttttagcctcttgcatgccatcctttgtaagtcatttgtctttatgcttgcctttgagaattggtttggatagaacatttttttgtcttctgtatagtactaacgctgagctactggcctcctgattccagggcacaagataatctttctagcacacagataccctcaa

SEQ ID NO: 361982 - DNA, 433 bp, Homo sapiens
  misc_feature (32)..(32): n is a, c, g, or t
  misc_feature (40)..(40): n is a, c, g, or t
tcgcaccgttggggagtacggaatcagatagnggcctaanaaagggtggaaatgctaacctggtatttatgcttaaaagaaacagtgagcaggttgtccagagcgttgttcatctctacgagctcctcagcgctctgcaggtgcgtgccttcatcttccatccctgcgtttatttgtctagagaacagcagcttggggctgttgttgacttggatctttgaggtttgcaggatgtttaatggataaatggggccctcagtctagggaagactggctctcgtggtgagaaagttacagaatgcatcgaccttccaggactagaattagtgaagagctggtgtgccgtaggcatggcttgataaccatgctacaaatcacatagcatgctaacatgcatctgggagattacttcactttagaaagccttaagtat

SEQ ID NO: 361983 - DNA, 449 bp, Homo sapiens
caaagctgctgagctctgccctgacggcatgcgcccccgcttctgtgagagcacgcttcctggcatgggggtcgaatcatgtcgataaaatgggctcggtttcatgaagtaccccacataacagtgagattcataggaccaaagcatggggaggtaagagcctgacttctttaaagcactaaattctagtaaacacagaaagagccagtggagttggttgttttgttttgtttccatcctgggaagaactaatttggattgttgcaaagggaagctatttcttatttattcaggtttgaagagcattgcaaggcttgagaggataagctggttgccataaaaagattttttaaacgattgaagtataatttaactttcctgagcaaaaaaatcagatgcttttccatttaacattttatgcatggaaaaacctttagcaaaatttagtt

SEQ ID NO: 361984 - DNA, 11368 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 361985 - DNA, 9325 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagcctcctcaacagtatgcacaccaagtcagggacgatttcatccgcaagtgacacctgattgctcctca

SEQ ID NO: 361986 - DNA, 8710 bp, Homo sapiens
taaattcgcggccgcgtcgactttttttttttttttctttgctcttcttgctgctagacattttattcttgatgtagctgaatgtacgactgacttttgttccactcttccattcagaatctttcttggaggggctatgtggcaggaaattatagttctcttctgttatactctcagtcagattagcactggtattgtggaaggtactgtggaagggccgtgaattgtccaatccaggatggctgattgtcattaatgagatggattttgtcaatggagaggaaatggctgatgtacagtaattaaatccctgctgcttagatctgtgacatatctgctgatcaaacatcctatgttctctctggtctgactccagatcctcttctgaaagtgacaccaaagagtcaacccgttcctcaccactgaatgggtgtctgagctcttcggcatttgcagagcttacttctagagatgaggatggcttgtttccgacaccagctcctcctgtcaagccttctagactgaaacttctgtaattaaagtcagcactcaggccagacttgctcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 361987 - DNA, 11449 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcagatactacttgggggagggcagctaatgaaaccttcaagctctatgcagtccacagacgtgagctctgtagagttcgcagaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 361988 - DNA, 7395 bp, Homo sapiens
tgttccatctgtgggtaaccatgttccgaggcagcaaagagaaaccgctattgctccgtggaaataaactatctgaataaaacttcttaacgggggttgaggctgaagctgaaacgggagtcggacacgatcttggctcctgaagtctttaaaggtcagtttgatgcacacttctataccaccacctgttaccagctgtagacagaagacctatctccatgcttgcccctaggcttttgtagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 361989 - DNA, 7652 bp, Homo sapiens
tgggtggatcagagtgtgttgtatgttagtgaaagtcatacttgtcccagaggctttttctcattctcagtggctttttcctttttgttttgtacaaatccttgcttttttgatgatggccaagatggactacctagcttcagctattaatctgttcccctgaagcttatgaatttagttttccatatgcaagttggtgctacactcagatttgtcataaaaagtcaatagtgaaatggatgttcaaaagacattgaattggatcctcgcttagttccaagcgcctacaaaggctagggaaaaccagtaaccatgcgataaaggaatagctcagcatagggtcagaaatgacactagccgctgacaacaaaagaatacttttccattttaacgcaaaagcaaaacaaaacacatgaaacctggagcatgttgtatgaatagtaaggcacaggaatcagtttttaaaaatgtactctgtaacccccctgcactttcagaaaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 361990 - DNA, 8875 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtggtgagtcacgcacacctgctctccctgtggccatagtgtctgtgcattctgagagagggtagattttagtggcatggggcggggttgaaaaggggacagttcagatgctcaaaagccaaactgccatccttttcaccagctccgcttgctaagagcactcatgcagcgaacattaagaacccactctgtgtggcacgtgtgcagaagcagagagcatgggtttcattttcaaggcattatccgatcgaggaactggagctcacccctcaatgaagtaattcaagtcctcgtgcctttctgggcctagag

SEQ ID NO: 361991 - DNA, 9068 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcagatactacttgggggagggcagctaatgaaaccttcaagctctatgcagtccacagacgtgagctctgtagagttcgcagaggtgggtaagtacccagccagcacacccagttgaattcagccaggatttattgagttggcatcacggacgctgacagcctccaagtgaaaacccttctcttgaatatgtacaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtggtgagtcacgcacacctgctctccctgtggccatagtgtctgtgcattctgagagagggtagattttagtggcatggggcggggttgaaaaggggacagttcagatgctcaaaagccaaactgccatccttttcaccagctccgcttgctaagagcactcatgcagcgaacattaagaacccactctgtgtggcacgtgtgcagaagcagagagcatgggtttcattttcaaggcattatccgatcgaggaactggagctcacccctcaatgaagtaattcaagtcctcgtgcctttctgggcctagag

SEQ ID NO: 361992 - DNA, 6921 bp, Homo sapiens
agtacaccttgttttgaggtacacttaaaagagaatcactcccagattctcttttaagtacaccttgttttgaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 361993 - DNA, 6548 bp, Homo sapiens
ggctctttttaacatgaggtcactgaaaatccataattaaaacattaaaaatgggccaggcggtagctcacgcctgtaatccaagcactttgggaggctgaggtgggaggattgtgtgaagccaggagttcaaaatcagcctgggcaacatagcaagaccccatctctacaaaaaaatttgaaaaatagccaggcgtggtggcatgtgcctttagtcccagcttactctagaggctgaggcaggaagattgcgtgagctcaggagttcaaggctgcagtgagctatcatcacaccactcagagcaagactgtctccaaaacagacaagtgaacaagaaaacattagtgacggatctaaggaaacttagccaagttttgataacggaacctgggcgttgtggcatactctataaaaagccattcagcagccttcatctaccttttattctgcttcacttttatttaacttctgtagccctttaaaaaaaatcaatcttcttgtttttatttagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 361994 - DNA, 5913 bp, Homo sapiens
cagtcttcatcccatcagacaaagtggtgaagaaagggaagaaggacaagaagatcaaaaaacgttctttgaagagctggcagtagaagataaacaggctgatgggagaagatgcgcatcttctcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 361995 - DNA, 7273 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacacgcatagggtccgagctcgattcgtatcatgta

SEQ ID NO: 361996 - DNA, 5396 bp, Homo sapiens
  misc_feature (41)..(41): n is a, c, g, or t
tctccgcccaaaactaggctaggtagcgaggcccggtgttntgagggagtaggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 361997 - DNA, 4744 bp, Homo sapiens
agctacatgatacgactcgagctggtaccctatgcgtgtacaacagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 361998 - DNA, 7152 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccacttcattgtcttgggtacacgcatag

SEQ ID NO: 361999 - DNA, 4633 bp, Homo sapiens
agatctcgccactgcactccagcctgagcaactccgtctcaaaaaaacacacacagaaaaacaaaaagaatctttgttttaccccgaaagagaggcagaggcagaaagtcttcttctgctttttgcatctctaagaggctgaaaaagagaatggaagtgctggggcattttggccagggcagtaatggatatttggagttggcacttccctcagctagaggagtctcagtgtgtctgagaaaatggcagtcagccatccaggattttaggagcaacgccactgctctgtgccacatcagaaatcaggcatggccccaacctgaaggaacttgtagcttaatggggaagcacaccaagaataaaagagcctccagaacatgtggtgcctgtggtcctgagacagcaggaaatggctctcaggccagagttgctggaagaacccatgtggcaggatcggtgggaggcagttacagagggaaacgcccatcccagcaactaggggaggccgccactcctctcgtggatggatgatattcttgcttggggatgttgagacagctgcactctgcatagttcctgatttgcctctctactgctgatgaaaaacctctctttctctatagctgctgcttatattggaaggcttttggttattcagcacactcactcctgagcttatttcagtgatattccttggttatttcgaaacatggatgcttgtggcagatggagagcctgggtgtacacagatctgcctgtgttttgaaatgcataccatgttgccgtttgtttgattgattgatcttggaccacgaaagaaaattatactgacagcttccagggtagggggcagttgtagctttctgcagatgttgccaaatatattgggggtggggagcagcaaatgccatgtgttgctttttatgacataaggagggattccacccccatcccaataaaatcggtgctttgacaaaggagggttcccaggcagctaagagaacccagagtagatgatcctctttatctctggtttaacctgtgactaggattcttggtgtaagctcggcttttccacttatcctctaaccggaacaggcttctataatctctttgccttaaaataattatctgcatccctgtgtagagcaatcttaagcagctctccttgtttcttcagggaatgggaattcttttctaagtcgccccatcaaaggtactattggttttttacaacgccggcgtttgtgtatgtagtaaaagtattaacagcattaaaggcgatatttttaacatgtttatagatactacttgggggagggcagctaatgaaaccttcaagctctatgcagtccacagacgtgagctctgtagagttcgcagaggtgggtaagtacccagccagcacacccagttgaattcagccaggatttattgagttggcatcacggacgctgacagcctccaagtgaaaacccttctcttgaatatgtacaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 362000 - DNA, 6725 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttcaggtgagaatgcagaacggtcacgagacattggcagcttgggggaacataacgtcggaaactattcaagacttatgcagggtagggtcagcctgtaagagagtgaccgtcggtcgcagggggaccacgcatggggtacaccgggacacaccgtatccagcatgcggtccgtcagataggacgatcccaacgacggagagtcgctgatgcaatgtcatccacggacatacacacctagactcacagacaagctcggtcacgcaccaccccgctcagcgcagactctctaactatcag

SEQ ID NO: 362001 - DNA, 3726 bp, Homo sapiens
atgagacgggcttgaaaaatgaggggagagttctagtccgtcatagtgcctggtgccccctgctgtggggtcgggagggatccagaagctcgctgtcgtcctggccagagttgcagggctcccctctgtgtgcctcccagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 362002 - DNA, 5465 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaa

SEQ ID NO: 362003 - DNA, 6047 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaaggtacagagttcattaacttgatggactaaccatgtcacctctgagcatatactaacaagcatctcattctgcttaatccatgattggatcatctacttttaagtaatgtcccatctaattcaggcaaataaaatataggtacttattaattgctagtgtccattttatatgaaatggtttctttaatttgaagttttatgctattttatcttttttaaaaattatttttaatttttttaaatcttgtgcttattgttgttcagatgactgtgagaatagggtctcacctagctttctctaggagagttcgaagaattgtctatgtcgtgcctatttaatggaccctggggagtactttttttttcttttccacaaaagaaaaaccaggaatgtgtgtgtgcttgtgcacaggccctaaagtattgtcaacacattgtttaataatgtaatgaaagactttattactaggccacctggcattttccattccattgtggatatagtcatttcttaaagcaagtcagaggcataagttcattccttggcctttgaattccttaattagtatttgtcaggtaatattttgaagctaaaaataaacgatttataagctgagaagtaatttctagtcagattgctaatttgcttcaaattttccgttggattttctttagaagtcattagtgaccttccattgtttagaaaaatatttagaaatccaaaaattagggttatattactgttagtttctcaggaggcatttgtaaagaagtatttttaactattagctgaacctgtttgttggcaagtgggcaaatagtgatctttcctactttgtctttttcaagtggatgctttctttaattccagattttaggcaagaaattgagctgaaattcagatattctcatgaatttcagataatcatgattcctatgaaattgttcttccagaaaataagttgttaaataagttttaaccccatctctactaaataagtttttcagtagaaggttctttggagatacgtttgtctgggtctttattaaagctcttcaatatgagcttatta

SEQ ID NO: 362004 - DNA, 3986 bp, Homo sapiens
  misc_feature (997)..(997): n is a, c, g, or t
  misc_feature (1019)..(1019): n is a, c, g, or t
  misc_feature (1025)..(1025): n is a, c, g, or t
  misc_feature (1028)..(1028): n is a, c, g, or t
cccgccaaaagcccaagcccccttccaagcccaggttccgccggcaataacgagcaacacgtgggaccaagacggagacaagtgaaaacgctaaccgccaaacttaacgcctaggacagccggggcatcgacgaggaactgggaccgaacgtcggaccaaagcctcacccaactgccgccgagcccctcattgagcagagaaaaaaagaagaacaaaccacccgctctcagcccgtgagtccgcgtcagaagtatcagcagaggtgaagagatcttctgctgaccctcttcctctctgctgaggcagctgcctccgatccggccagcccacctctcctgcgtccccgcgtgcacaagtctcttacactgacgcccactgctcctcagcgtccagtcctcctgggcggccccaggtcctggacaataagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggnccctgcgtcccctctgcctcanccgccngtntgggttaacaaagccaaaggaaaaaaaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 362005 - DNA, 5299 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacatattcacggcccttccaccagtacccgccaccatacccgtgctaatctgacttgagtataacgagtcgagaacata

SEQ ID NO: 362006 - DNA, 2894 bp, Homo sapiens
cctttgcctataccctcgtgactgggggagctgatccctccgatgtgaggggaaaccatgtgaggagcgacacagctcttctcccgcccgtgttggtgccacagtggaaggattggcggagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 362007 - DNA, 2503 bp, Homo sapiens
  misc_feature (31)..(31): n is a, c, g, or t
  misc_feature (958)..(958): n is a, c, g, or t
cgtcgtgtatcccaccaccgttccgtacggntgtgtcgccctctacgaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagtgagtatcactgtgggcattgcttgtgatcacctcagtaggatcctgtcacagcctgcattcacaccaaaactggttaaatcatggggacataaatggaaataaattcaggattactctccgaaatcgcctaatatttaaaggaaaataataagaagaaaaatagcaagaagtggaactaccagttactgagttttcactatatgctaagtgctttccatatattatttaaccctttcaacaaccctgtcaggtaggtgttatctctcttttctaaaagtgatgtaccttaccgaggatactcctctaatgtgaagaagtagttcaaaccagatctctttggtttcaaatcccatactcttaaaccacagtgcttaaatctgtaatatcagtttaaatgcaacagaaggattttatgcaaagatcaaaggattgaaaatatttatatttgggtttagagggaaggattatcccacagaagattacaagaacttttaagactaatatgatttcttagatctatttctaattaggagcatttggaatatattctcttagtgattaagagattaaataaatgtttaaaccgtgtgtgtgtgtgtgtgtgtgtgtgtctgtgtgtgtgtgtgtgtaaggctccactgtatcacccaggctggagcacagtggcgtgaccatagctcactgcagtcttgaactgccaggcttaagcagtttcctgnctcgcaccgtagcctcccgagtagccaggactacagtcatgttgtgccatcgtgctgagctatgtttaaatttgtttgtaaagatgaagtcttgctgttgtgtctaggccggtctaatgccttacctcaaacactcttctcgctgcaggcttccgaagccctgggtgtgatccaccgtgcccagcctaaagtaacattttttatctaattatttttcacatgctcattatggaaatcttcaaaatctaaaagtaaaagaatgaaaatctcctggaataaccccgcttagagataactacacttaatgttttggtttatatatttctaatcttttttaaaaatgtattttcaaaagaaagggagaaaagaagttcactttcttatactgattcccagtgctaaaccaaaactgattccatttcaagtccgtggggaaaaacttttcgcctctcacaccctgttcatctacccacaacaccctctaacaaaataaagacataagtaaataaaaatttgaaatcagttaaggaactcttgcaaggaatcactgtgtgtgtgtgtgtgtgtatgtgtgtgtgtgcacgtgcatgcatgtgtgtgtgtgtgtgtgtgtggtatatacatgtacatacagatatatacacacgtagatacatgcatatttagaagtaagggaataaacaaacattgaattcaagaatattgtcataaaagggcattgcctcctccctcacaaaacaaggtgcactaagcttctcaagccctcacttcagtgggctgatggaaatatagccaaagtattttaccatgttttgtaagatctcttggtttagcaaatacattcaaagaaatttttccaccaaacgtgccacaagaattgtgttttcatttctcctgtgcaagtacagaatggagagaaagtaggaatcagggagagatgcaaagagtctagcaaattatttctagcataatcacacatttaacttcagactcagccttgtattataattccaaaaaaaaaaaaaaatgagggtcaaagaatacggtttacccagtatcctacgtattaacatttgggcagccaggttaaaaatagagcctaacctatttaactaaccactgccggctgggatactagtgggtatcaacaaaagaaaatcccccttggacagagcaatataaattagccaagtattattaaatgccttgtatagtcttagcatcccactaggtgttaacaggcacctaagagaactaaagctcatagtcctgaccttgaaaaactttatgatctagttgggatgaattccaaaatgtttccatggttttttatttggctttaaaactactgaatcttgtcttcaaacaagcttttcgtggaagaccaataaataagtggagattccccctttctagccatctccccaatgtcatggagttttaggacagagcagtgaatgtaccacttatctcatggataaggtaaaacatacacatgataggaaaaaaacaacgtaagttggaatttagaaactggaccctgac

SEQ ID NO: 362008 - DNA, 887 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgagtaagtgctccttctgccttatttctctcctctcatccccagccccacc

SEQ ID NO: 362009 - DNA, 590 bp, Homo sapiens
tcagctttgcatgtttcctttattccagtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggtaaatgatgtgaagtcatgagcttttataggcaatccttgactatctcacacaactcaaaatgacttgtactttagtagctacatcaccgctcccaatcagcaaatttcttagtgagatttcaagacactcaagagcttgtcagtcagactcatattcattttgagtaacaaaaaagattttcctaagatctcagctaaaagagtaataatacatgttcctgcttccatttcttctgcatccgtaaaattattaataatcacttagctgccaccaagcagctccccctttttgggggcatcagtaggtttcagacatactacatccccaagatgcctatatgatattctttccttggctaatctgtttcacaactttaaaaaaaaaaacaaccctatttttt

SEQ ID NO: 362010 - DNA, 465 bp, Homo sapiens
aaaaagaaaaggcagtgtgggtggggagggtgtcctgtcttgtcactttccataaattaccacaaggtggtgctcgtgtcttagtcattctcgtaattactaaacaccaatcaaatcacagatcattttctccttcctgcagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgagggtaattaacattcagcattgccccctcttcatctactcccagagtggtttacacactaatattacctgccagtttttacttttttactttaaagcacaaatgcagaaaattacccaaaacaaatattt

SEQ ID NO: 362011 - DNA, 287 bp, Homo sapiens
caattgtgatcatcctattaaaaaaacaagtctctgaggccaattatgatcttacctgcctggaatccactgagaagccattggcttgatctagaataactgaggctatctgattggccctgctggcttcaaccatatgtgctttctctccattacagccagaggaagagcatttggcctgtgatatcaccggatccagttcatccaccgatgacacggcttcactggaccgacattcttctcatggcagtgatgtgtctctctcccagattttaaagccaaacagg

SEQ ID NO: 362012 - DNA, 445 bp, Homo sapiens
cgctgacaacaaaagaatacttttccattttaacgcaaaagcaaaacaaaacacatgaaacctggagcatgttgtatgaatagtaaggcacaggaatcagtttttaaaaatgtactctgtaacccccctgcactttcagaaaaatgccagacgtgaaagctgaagatgaagtggattttagagcaagttcaatttctgaagaagtggctgtagggagcatagctgctacactgaagatgaagcaaggcccaatgacccaggcggtaagtggcatcagtaagtctataagggcacaaaatgtgtttatcctgttctgctgtgtcttatttatggctttgtcttttatttgagggtaagtgggcaaaatagtattttcccccttccctcttgtgctgttatataaatgtgtttatgttgctgcagctaagctttcataaatggtata

SEQ ID NO: 362013 - DNA, 853 bp, Homo sapiens
atgagacgggcttgaaaaatgaggggagagttctagtccgtcatagtgcctggtgccccctgctgtggggtcgggagggatccagaagctcgctgtcgtcctggccagagttgcagggctcccctctgtgtgcctcccagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaaaaaactaaaacaaggggggcaaaaggcccccccggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtaatgggactccctgccgagagcaacctaatgatgatattaattaagaccccctgtgtattaagcaaggtaagaaagtgagcagaaatatagagcctgtttttggccagatgctcatgcctgtgatcccagcactttaggaggctgaggtgagagggtagcttgaccagcctgggcaacagagggagactctgtctctcctaaaaaaaaaaaaaaaaaacaaacaaac

SEQ ID NO: 362014 - DNA, 5337 bp, Homo sapiens
agatgtttttagtatacttttaaggaagagaaccccaggtatgaattgtgatcattcttattttcataatctaacaggtatgtatttattagccaaattttttagaaactgcattagaattctgtatattcagaaatggagatgagaatgtaaacaaattattacatcattcacctagacagcatttcccggaaccgcataggccattgacattatgctgtttccccatgtgctgaaggccctggcataatccgagcatgctctaatgtcttctgtgaacctccttctcagctcagcagcagatgcggccagcaaggcggatctccatcagcatctctccgctcctccttaagtctaaaactctcttttctcttggctcttcttattcgagtgatgaggaggaggagttgcataattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgaggcaatgcactaatgtgtaaaaattaaccgaatgcaactattttataatggagagctcttaccttttccttccagttcttaaactggcataaactttattgacttcatcctcctatttttatagcaacctagttttagatggtacaagttgaatttctatcacaagacaataaaataacatgaaagcattatcctagttaatgctatttcaacttaagaaatatctacattgaagtatttgataataattgtaaagttacttaaccgtatgtcatgttcagacagtatgtagcagctagtaacgtgcctggcacagagttgatgcttaataaatagttgctgaataaatgaaaaagaaaaacctgcctttggttgtgcatactttaatcactttctgatttagaaaaagatcagtctagagctcactactgcacactacatcaaactttgctgtaaacaaaagtaacaacttcaaacagaaaaatattacctgttagtgatagtcaacttatataaagagcccacacatttctatgcaaataattaaatttgatgttctgatgtttaacccttaggtaaagaaggccaaagtgtgctgactggctaatttgtatgctttatagtaataatgattagttcctcaagcggccgc

SEQ ID NO: 362015 - DNA, 644 bp, Homo sapiens
atctgatacgggcgagcgctgaccctatgcgtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacacgcatagggtccgagctcgattcgtatcatgta

SEQ ID NO: 362016 - DNA, 9324 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcacca

SEQ ID NO: 362017 - DNA, 11481 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaaggtattgataagaaacatgaaaatccccgttattgttgagagccatgtgtccctgtcggctttcactagagcctttttcatgtgattcctcacagtctgtttactcccttgcagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 362018 - DNA, 11561 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcagatactacttgggggagggcagctaatgaaaccttcaagctctatgcagtccacagacgtgagctctgtagagttcgcagaggtgggtaagtacccagccagcacacccagttgaattcagccaggatttattgagttggcatcacggacgctgacagcctccaagtgaaaacccttctcttgaatatgtacaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 362019 - DNA, 11451 bp, Homo sapiens
  misc_feature (8462)..(8462): n is a, c, g, or t
  misc_feature (8484)..(8484): n is a, c, g, or t
  misc_feature (8490)..(8490): n is a, c, g, or t
  misc_feature (8493)..(8493): n is a, c, g, or t
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggnccctgcgtcccctctgcctcanccgccngtntgggttaacaaagccaaaggaaaaaaaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 362020 - DNA, 11314 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 362021 - DNA, 11434 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtatgagctggtgcccctctggtgtgcagtactctgctggcctgagtgctgactttaattacagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 362022 - DNA, 8461 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtaatgggactccctgccgagagcaacctaatgatgatattaattaagaccccctgtgtattaagcaaggtaagaaagtgagcagaaatatagagcctgtttttggccagatgctcatgcctgtgatcccagcactttaggaggctgaggtgagagggtagcttgaccagcctgggcaacagagggagactctgtctctcctaaaaaaaaaaaaaaaaaacaaacaaac

SEQ ID NO: 362023 - DNA, 8495 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaaaaaactaaaacaaggggggcaaaaggcccccccggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtaatgggactccctgccgagagcaacctaatgatgatattaattaagaccccctgtgtattaagcaaggtaagaaagtgagcagaaatatagagcctgtttttggccagatgctcatgcctgtgatcccagcactttaggaggctgaggtgagagggtagcttgaccagcctgggcaacagagggagactctgtctctcctaaaaaaaaaaaaaaaaaacaaacaaac

SEQ ID NO: 362024 - DNA, 6056 bp, Homo sapiens
caaagctgctgagctctgccctgacggcatgcgcccccgcttctgtgagagcacgcttcctggcatgggggtcgaatcatgtcgataaaatgggctcggtttcatgaagtaccccacataacagtgagattcataggaccaaagcatggggaggaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 362025 - DNA, 5797 bp, Homo sapiens
ggctgggacacagggtgcttagggcagtgcaaaaagcagagtgggaaaggaagctgaactgcttgctcccttcctactcggcttctcagggcttgtcagaggtgaattgtcaatggacttactttctttctctttagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 362026 - DNA, 5411 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaa

SEQ ID NO: 362027 - DNA, 4739 bp, Homo sapiens
atctgatacgggcgagcgctgaccctatgcgtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcagcctcgcacccaggccaggcagaagctgtgctctgaagctaggacagctggctgagaagtgggttcaggcgaagggtgaagccatgtgtagcagttcctgccagtgcagatctggagaggagctggcccggaaggcgtggttgtgaaagcgcccttcttatgttaggaggccttggcaaaattggatttcttcaaaaatacatgtaaaggtctgttgttgaattgtactctgcccctggaagcagatacagatggctgcctgctgctcggctttgcttttgcttttcccaccgtgttttcatctttgttcacttgaggctttccccagctggtgtgtgcaggacagttcatggtaatgttgccctctgaggccccgtacaccagaagggaggccctggaaaattttgtgcttccaacgtggccttcaattcttgcttttttgcccctcggaagcatggggcttttgagcacacttaaaaaaagaaaaatctgtaacttggtgcttattgatgaattgcaagctggccttgcagatggagatatttatctttcagtttatttgaaagaggtctggtttaaaatttgtagcctacatttgttttatttattgtatttgtgtgtttgtgtttgtttttttttaagggtgagccaggtctagcccaacagtctaaactatccagtcaataccgagtgaagtggcagccagcactgttcactctgtgtcttttgaagtgccttgaaggcccagatgaaattttaaagggagggggtccatgtccttccctcccccaccccgcctcattctttaatcaaaggatgtcttctcccttgtttgagaatgaagaaactcgccacctctgacctacctttgcctttttctgtcatggagaatactcacccttcagaaacagaccaaaggccaaaacctgctgatttttctattgaaaatatgtccccttgcaaagaccctaaacaaaaagttaagtttctttctttcacctatttgtacaactccaagttacagctgaatctgtcgtgactttcctgagatctacccggggcttggctgtctgttctgggcactggctccgagttcccctcctgggatttgcaggagggcagtactgaacctgcattcttctccttgtaaatgtaggccgggtgcccctgttctccgggtttggaacaatacgaggttggtgctgatgggatttacttgcgtacgtgctcttcacaaaaacaccgtggatgctgaagttagagcacgtcgccacagagcttgacatcaatgttagagggtctcttactccccgcccagctgtgatgtttcatctgctttggttgttttggtggtcttttttaaaaatagagatttcacatctgcccagaccccactcaaaacgatttggtcaggttctggttggacaagtttaaaatcaaagtagtgcccggaattccctcaaaccacccaacttcatccaggaatacagtctgcagtgcagcaacagaaccgcttaccaagaactgtgcttacatacctttgtcatctctcttccccccttggaagttgtcctcagggggatttgttcctgtcctggggatttacctgggatggtggctgcctgtgcttttgctcatggccttgacagtgctctagttgctggatctaatggcctgtcttggtttctatcacatgagaaggggttgtttttttggggtgactcggactgaattccccatactgtt

SEQ ID NO: 362028 - DNA, 7187 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaaggtaaggcttggctcttttgtcttaagtatgtgcccaggtaaaacaggcaaaaatccaagtgcttttgttggaaattcactaccagatttttttcccagagagcccatctctaaacactacccaggagcaacaagcatttagttcttcgtaatcttatatcaaaaatggtttgtgatggcctgcaaaatcatacaaaatagaggaagaagacaaagaaatgatgcagtcagggaaaatggaaaataaggttttaaaaaaacaaagcaaa

SEQ ID NO: 362029 - DNA, 6074 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgaggaggtagtcacgactgtaattgaggcactccggggaattgggatgggccca

SEQ ID NO: 362030 - DNA, 7678 bp, Homo sapiens
  misc_feature (6133)..(6133): n is a, c, g, or t
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagtgagtatcactgtgggcattgcttgtgatcacctcagtaggatcctgtcacagcctgcattcacaccaaaactggttaaatcatggggacataaatggaaataaattcaggattactctccgaaatcgcctaatatttaaaggaaaataataagaagaaaaatagcaagaagtggaactaccagttactgagttttcactatatgctaagtgctttccatatattatttaaccctttcaacaaccctgtcaggtaggtgttatctctcttttctaaaagtgatgtaccttaccgaggatactcctctaatgtgaagaagtagttcaaaccagatctctttggtttcaaatcccatactcttaaaccacagtgcttaaatctgtaatatcagtttaaatgcaacagaaggattttatgcaaagatcaaaggattgaaaatatttatatttgggtttagagggaaggattatcccacagaagattacaagaacttttaagactaatatgatttcttagatctatttctaattaggagcatttggaatatattctcttagtgattaagagattaaataaatgtttaaaccgtgtgtgtgtgtgtgtgtgtgtgtgtctgtgtgtgtgtgtgtgtaaggctccactgtatcacccaggctggagcacagtggcgtgaccatagctcactgcagtcttgaactgccaggcttaagcagtttcctgnctcgcaccgtagcctcccgagtagccaggactacagtcatgttgtgccatcgtgctgagctatgtttaaatttgtttgtaaagatgaagtcttgctgttgtgtctaggccggtctaatgccttacctcaaacactcttctcgctgcaggcttccgaagccctgggtgtgatccaccgtgcccagcctaaagtaacattttttatctaattatttttcacatgctcattatggaaatcttcaaaatctaaaagtaaaagaatgaaaatctcctggaataaccccgcttagagataactacacttaatgttttggtttatatatttctaatcttttttaaaaatgtattttcaaaagaaagggagaaaagaagttcactttcttatactgattcccagtgctaaaccaaaactgattccatttcaagtccgtggggaaaaacttttcgcctctcacaccctgttcatctacccacaacaccctctaacaaaataaagacataagtaaataaaaatttgaaatcagttaaggaactcttgcaaggaatcactgtgtgtgtgtgtgtgtgtatgtgtgtgtgtgcacgtgcatgcatgtgtgtgtgtgtgtgtgtgtggtatatacatgtacatacagatatatacacacgtagatacatgcatatttagaagtaagggaataaacaaacattgaattcaagaatattgtcataaaagggcattgcctcctccctcacaaaacaaggtgcactaagcttctcaagccctcacttcagtgggctgatggaaatatagccaaagtattttaccatgttttgtaagatctcttggtttagcaaatacattcaaagaaatttttccaccaaacgtgccacaagaattgtgttttcatttctcctgtgcaagtacagaatggagagaaagtaggaatcagggagagatgcaaagagtctagcaaattatttctagcataatcacacatttaacttcagactcagccttgtattataattccaaaaaaaaaaaaaaatgagggtcaaagaatacggtttacccagtatcctacgtattaacatttgggcagccaggttaaaaatagagcctaacctatttaactaaccactgccggctgggatactagtgggtatcaacaaaagaaaatcccccttggacagagcaatataaattagccaagtattattaaatgccttgtatagtcttagcatcccactaggtgttaacaggcacctaagagaactaaagctcatagtcctgaccttgaaaaactttatgatctagttgggatgaattccaaaatgtttccatggttttttatttggctttaaaactactgaatcttgtcttcaaacaagcttttcgtggaagaccaataaataagtggagattccccctttctagccatctccccaatgtcatggagttttaggacagagcagtgaatgtaccacttatctcatggataaggtaaaacatacacatgataggaaaaaaacaacgtaagttggaatttagaaactggaccctgac

SEQ ID NO: 362031 - DNA, 5531 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggagttcaatgcgagttcttggggatgttgtcaggagacctcccattcataggagaagtatgagctggtgcccctctggtgtgcagtactctgctggcctgagtgctgactttaattacagaagtttcagtctagaaggcttgacaggaggagctggtgtcggaaacaagccatcctcatctctagaagtaagctctgcaaatgccgaagagctcagacacccattcagtggtgaggaacgggttgactctttggtgtcactttcagaagaggatctggagtcagaccagagagaacataggatgtttgatcagcagatatgtcacagatctaagcagcagggatttaattactgtacatcagccatttcctctccattgacaaaatccatctcattaatgacaatcagccatcctggattggacaattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaa

SEQ ID NO: 362032 - DNA, 5092 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctttgtttccaaatgctctatggacatttgtgtgctaaatcctattaaataaaaaagacgggttaaaacccagatgctgtatattcatttgtaattatgtataaagtgaagcagttttaaactgtaaagatttttttcagtgtgttttctcgaattttgccacaacatactggcttcgtattttatttatctttctttctagttaccagcttcagacccttgtaaagtctccctcagccctttcaaaaaataataaatttcctgtgaagttct

SEQ ID NO: 362033 - DNA, 5275 bp, Homo sapiens
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcagaaatgccagacgtgaaagctgaagatgaagtggattttagagcaagttcaatttctgaagaagtggctgtagggagcatagctgctacactgaagatgaagcaaggcccaatgacccaggcgataaaccgagaaaactggtgtacaatagagccatgccctgatgcagcatctcttctggcttccaagcagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggaggtgagatgggaggcggtttgtttagtgtctcagtgtctgcttgcttttgagaagcttctgatttgtattattgttggtaaaagaatttaggagaccccatagtatagaagaaagaatataggctttggaatcaggaaaatctgtgttcagaccccactactcgagaggatgagatgggaggattgcttcagcccagaagttcgaggctgcagtgagccatgatcataccactgcactccagtctgggcaacagtgagaccctgtctcaaaataataataataatagtagtaataataattgatgtaaacagctcagcaatagcaattatttgctcaaatttctcaacctcctga

SEQ ID NO: 362034 - DNA, 4305 bp, Homo sapiens
  misc_feature (4142)..(4142): n is a, c, g, or t
  misc_feature (4246)..(4246): n is a, c, g, or t
  misc_feature (4265)..(4265): n is a, c, g, or t
agcgggaagcgcctgtgctctgccgagactgccgtgcccattgctcgcctcggtcgccgccgctttagcccgcctccgggggagcggccgcctattgtctttctccgcggcgaaggtgaagagttgtcccagctcggcccgcgggggagccccgggagccgcacgtgtcctgggtcatgaaacttaatccacagcaagctcccttatatggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatgaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagcaggcctgtccacatcctccactgctgcagagcttcagcacgggatggggaataccagtctcacaggacttggtggagagcatgagggtcctgcccctccagcaatcccagaagctctgaatatcaaggggaacactgactcttccctgcaaagtatgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcaggcttctcctctggatgttggagtgaagaacactcaatcccagggaaaaactagtgcctgtgaggtgagtggaaatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcacgcgagccccgccttcaggcagagaaaggagcactccctctctaccttgcatggtctctgcccaggacgcacctctgcctaagggagcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccctgctggaagcntgcgtccagcagccgatgctgcagattcggccccatctccaccaggcccagggaaacactcactccttactgcggcaagagcggctccatgaactacccagcancccagtgtttccactgagnttttcagattccaggcgtggggactggcaggagggacaag

SEQ ID NO: 362035 - DNA, 767 bp, Homo sapiens
ccaacctatttccataattagtgtaaataaaattttccccaaaaatcagtgtaaaagaagaaatttctacttatagtgcctcttgtgtaggagatgtcaacattgagtatattgttttatcacaactgggtctagtcagctgaaggcaatcaatgaccaggcaatatgagtaaccaggtagagatctcgatggatctacccgaatgctcttttcttgaccaatgaaaaatcaagcttattaaaagtgtacacatccacattccagaattattccatgctacgcgaaatgctacttttcaatcctaattacaatgagcagaaccaccttttcttaccacttaaaaattcctgactcttcctactcagcaaactgcccaagtgaatgtcttcccttctgtgtttcactgcctggccagtaaataagctcaacttttctcctttcagtagctctggtggcctttacctcaggctttgatgacagacagaggaaccaacaatctaacctgatgcctgcctctccccacgccagtgctgaggagctcctgcagagaaagcctgctcttccagcccttgtattcaggacaggtgccgggtggtccctcaagaccctttttcagcagtaaatcctagctgctttcactgagttctcactaagtttatttggtttaatctaggttgtctgaggttccacaactcataactgattttgtgttctatttctggccagcaacttccttgacattatggaaacttgagttgggtggagt

SEQ ID NO: 362036 - DNA, 800 bp, Homo sapiens
actaggagcacaaatgctccagtgtgaaactgacttctcctggggatggtagggcttcctctgtggtccagtaatggtgacgtccctaactggcagcctgggccccagcgtcaggagttgggctcatggtgacacaaagcatttcactatccaacaaaatgtttattccaggattttggttgatttcattaatcagaaaatgcattttagaagaaaatgagtctctgatctcaggatttgtctgatctctcacgattgggatggcccattcctagaggggtaaggtcccacgttgttaggaaaactcatttttagccagttatgaagtcttatattctacaaagaaaaaataggtgaaggacagagaaaggaagcagaggaaagatgagaaaataacaaatattttttaaaaagggagaacaatcctggaaaactgatataggccatattactccgaagtcaatacatcagtagggagaagacctggaaaacactgctagaccaactcaaaattacaaagttttccagagcttatatgtcttctaagccatatgtctatgtgtaagtatgcattcatctaaagacataagtgattaacttcttttaatctgtaactaagatctgagttctgaagaccttcctctggagcctgagtaaatttacttaatctaaatgggtccaggttccggggtgattacccttatcttgtctcctgctaaatcatggaggattgggaagttccttcagaccccagtaaacttgtttgtggaggcctggggagtttcttcagacccccaata

SEQ ID NO: 362037 - DNA, 382 bp, Homo sapiens
ggagggcagaaaggatcgaggtagagctctggctctggatctgctgcagagagaaaagttagctctggtggcctttacctcaggctttgatgacagacagaggaaccaacaatctaacctgatgcctgcctctccccacgccagtgctgaggagctcctgcagagaaagcctgctcttccagcccttgtattcaggacaggtgccgggtggtccctcaagaccctttttcagcagtaaatcctagctgctttcactgagttctcactaagtttatttggtttaatctaggttgtctgaggttccacaactcataactgattttgtgttctatttctggccagcaacttccttgacattatggaaacttgagttgggtggagt

SEQ ID NO: 362038 - DNA, 832 bp, Homo sapiens
actaggagcacaaatgctccagtgtgaaactgacttctcctggggatggtagggcttcctctgtggtccagtaatggtgacgtccctaactggcagcctgggccccagcgtcaggagttgggctcatggtgacacaaagcatttcactatccaacaaaatgtttattccaggattttggttgatttcattaatcagaaaatgcattttagaagaaaatgagtctctgatctcaggatttgtctgatctctcacgattgggatggcccattcctagagggggagaagacctggaaaacactgctagaccaactcaaaattacaaagttttccagagcttatatgtcttctaagccatatgtctatgtctgcaggaatgtagacaattcagaggctttgttccccataatttggaacttttcttcagatttgaccaagtcgggtagagatgatcaaacctaatgggaaaaagactgaaacaacaaaaacagaaacaggcaaacacaaccagtagctctggtggcctttacctcaggctttgatgacagacagaggaaccaacaatctaacctgatgcctgcctctccccacgccagtgctgaggagctcctgcagagaaagcctgctcttccagcccttgtattcaggacaggtgccgggtggtccctcaagaccctttttcagcagtaaatcctagctgctttcactgagttctcactaagtttatttggtttaatctaggttgtctgaggttccacaactcataactgattttgtgttctatttctggccagcaacttccttgacattatggaaacttgagttgggtggagt

SEQ ID NO: 362039 - DNA, 802 bp, Homo sapiens
gtctttggacccctgaacaacttggggaagaggatgacctattcccatctgtcccttagtactcaatttagaatgccaggaaggaagtagaggggagccctcttgtggcagttgctgaagccttccagttcttttgaggggataggggatgaagaggagactgaacctgggaggtagatacttagcacccagctcttaggacaaacagcaatcccatcttccagaacatgcatagcatcagtcatggactggcggaagacttggacccagggtccacttcaggataatctgggcaagggagcttcccaaatgagcctgtagaaagccagtggaagggcttaggttggctaaggtgggatggagggcaaaaccctccccttcattgcagagtataggggcagtggcagagaatgaatgtatgtgtgggtttctcagccttgaggtataaggtctaaaggctctggggattcactgcatacaccacttccagttcaagcgcctaggttggttacagcaggaagttgacaagtatgtatttagtacattcgatgtttttaggcatctgctaaaagtaggtcaaaccactgaactcagggagggggctggggatccatttctaggatgctgtggaatccttttgggacatctgtagtataccacgttgggtagtgagagttgggggacaccccttccattgctgctgcttagtgtagggagtcatgtctttgggcagcagtaatattattaagaaaagctttttttttttttgagacacagtctctgtcacctagcgcctatatgc

SEQ ID NO: 362040 - DNA, 328 bp, Homo sapiens
atgtctagaggatccctataggcgcctaggttggttacagcaggaagttgacaagtatgtatttagtacattcgatgtttttaggcatctgctaaaagtaggtcaaaccactgaactcagggagggggctggggatccatttctaggatgctgtggaatccttttgggacatctgtagtataccacgttgggtagtgagagttgggggacaccccttccattgctgctgcttagtgtagggagtcatgtctttgggcagcagtaatattattaagaaaagctttttttttttttgagacacagtctctgtcacctagcgcctatatgc

SEQ ID NO: 362041 - DNA, 470 bp, Homo sapiens
tttggcacattctcaatgcttaagaatgttacaagtgtaaaaagcaaagaagagggctgggcgcggtggctcacgcctgtaatcccagcactttgggaggccgaggcgggcggatcacgaggtcgggagatggagaccatcctggctaacatggtaaaaccccgtgtctactaaaaatacaaaaaattagctgggcgtggtggcgggcgcctgtagtcccagctactcgggatgcggaggcaggagaatggcgtgaacccaggaggcggagcttgcagtgacctgggatcgcgccactgccctccagcctggctacaggctgggcgactccatctcaaaaaaaaaaaaagtaaagaagaggttcctcttaaaagactttcctccccatctaattaaaaataagtagtaatttctcttaaaagcaaaatttattcaaagacctgtgctaacattcttaaatatctaccagc

SEQ ID NO: 362042 - DNA, 653 bp, Homo sapiens
tgaactgcacaacatagatcagaaggacattccagccagtggcacagcttcaggaaagatgcagaagcgtgaatatagcccgaagggtgtgtattagcttcccacggctgctataacaaatcaccccaaacatagtgacttaaaacaatacaaatgtattttcttaaaggtctgcggatcagaggtctaaaagtgtcaggaggtctgtgttccttctgggagcttcagagagaatctgtttccttgtctgtttcagcttctggaagctgcctgcatttcttggcacctcctcacgtcactatgacatctgcttccgttgtcacctcctgtgactgaccctgaccctcctgcctccctcttaaaaggaccctcgtgactccattgagcccacccagacaatccaggataaccaccccttctcaagatcctttacttaatctcacctgcaaagtcccttttgccatggaaggtcacctcttcacaggttcaggggattaagatgtggacatcaccgggggtcatgattctgattgctacagggtctgagaagctagagagtaagtgtgtccagtggtggagagaagccttgaatgccgagctaaggagcctggacttggcctttccttcaaaatagatgcatgacctgtcagcct

SEQ ID NO: 362043 - DNA, 330 bp, Homo sapiens
ttgaggtgagacccgtctcaccaatgtttttttcttttcttttttaacttgagaaatttaccttcttacattgcagaaatcactactttaagaacaacctaagaaaaattactatgaaatattttcttcaaagtatatttatcccctctctagagaacttccttttgactgtgttaaaaagattttttctaatttgtggtcatcagtcaattttctaagtacttgaagaggtgttaatgtaatttatatcattagaattttaatattatgcacaattactttatttttagtattgtcaccaatttttaaattaacaatccatccttattg

SEQ ID NO: 362044 - DNA, 400 bp, Homo sapiens
tattctgccacggtccacccacacaaataagcttcctctgtcaaataagtacaccatttgaaaaactaaaaatactaaatgtactggcttggagaaaattatattcatcagaatccctctctttcaagaagggcattgtatttgttcagaagcatttccttgaccaacaccctggaatagacgttgaaaccccatgggccctagcagtgcacagaacaacactgaagaaaaaagggggaggatttccatggctgtaccagagagaatggaaacagaaatggaagtgaagagtggaataaggctgtgcaaactgtgacagaccccttcacatcctcagtgtgattgccagatacactaagtgatgctgttagtgggctagcttgaaaacaaaccaaccaac

SEQ ID NO: 362045 - DNA, 623 bp, Homo sapiens
ataaacatctgtttctgcagatatgatgggtttgaaccagcactaaacattataattgctatcatttactatagctgatggtgtggtgtttacatgaatcattaagaggcttgcagtaaataggtagtgagagctagtgcctatttctttgactttaatggcacataaaattaattgcttgaaaataatctttcaaaatatatatttcttgatatctataaactcctgcagagataatccaaaaaggttttgtgggctgtctcaaggatgtacattttatgaagaattacaatccgtcagctatttgggaacctctggattggcagagttctgaagaacaaatcaacgtgtataacagctgggagggatgtcccgcttcattaaatgagggagctcagttcctaggagcagggttcctggaacttcatccatatatgtttcatggtggaatgaactttgagatttcctttaagttcagaactgaccaattaaatggattgcttcttttcgtttataacaaagatggacctgattttcttgctgtatgtgaattaatttgattaaaattactttaaaatataggacccaactttaaaataaataaaccatgtgttggctttaca

SEQ ID NO: 362046 - DNA, 633 bp, Homo sapiens
cattcccttaaggggtcaccagtggaagtaactacaactaatgatcatggcaaacaatatagtgatggaaaatggcatgaaataattgctattaggcatcaggcttttggccaaatcactctggatgggatatatacaggttcctctgccatcctgaatggtagtactgttattggagataacacaggagtctttctgggagggctcccgcgaagttataccatcctcaggaaggatcctgagataatccaaaaaggttttgtgggctgtctcaaggatgtacattttatgaagaattacaatccgtcagctatttgggaacctctggattggcagagttctgaagaacaaatcaacgtgtataacagctgggagggatgtcccgcttcattaaatgagggagctcagttcctaggagcagggttcctggaacttcatccatatatgtttcatggtggaatgaactttgagatttcctttaagttcagaactgaccaattaaatggattgcttcttttcgtttataacaaagatggacctgattttcttgctgtatgtgaattaatttgattaaaattactttaaaatataggacccaactttaaaataaataaaccatgtgttggctttaca

SEQ ID NO: 362047 - DNA, 499 bp, Homo sapiens
tgcttctccttttctttcacttttttctccccccccattcttctctggattgaaaactgagggatagtgttaactaatgatgatgtgaattataatcaaatcacattcactgttggggtatcactagaatatactgattcttttttcccttagacttttaagcatgcaagatgtggtccatatgttcattcctttgttcctttgttctgcatcttgatcataattcatggtcctgcaatctaaagagtatgttacaggctcaacactgggacactcaaagcaagttctgtttaaaagatgtgtggtgggtcaagcctgaataatccaaaggaactccaaagcataaactaaggtcataaatgtttaaggaaacctagccttgagttttcccataggacagagggaggggaaagagaaatcaaataaattccagctagataagcagtctgagtgagggacaagagtagtgggggaatggggaaaaggagatcataaagcc

SEQ ID NO: 362048 - DNA, 335 bp, Homo sapiens
attgcctggggtcacccaattaatttacaactgtagcaggcggacactgattttggctattgatatgaagcacactgatctcatgcaaagaactgtgcagctggtgccatgggagaagaccgtcagatcctttctaatggaaaaatgaagtcagaccaagcttgcctcctttctttacaaaatgtaattatgtaaatgacaaagctctattatagacaatgtttataattagcactattttccctttaattttaaataaagcatgttagttgtgagtgccatgccaacatattttctacagatgctataaacaatgcacaatcagaaatccattt

SEQ ID NO: 362049 - DNA, 853 bp, Homo sapiens
catgatggaagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttcgttgggggggagccgaggttccgggaaggggctaggccggcttgaaaagagattatgactgtaccttttaactttgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagacccgtaagaaacagaaggaagatgtggaagttgtaggaggcagtgatggagaaggagccattgggcttagcagtgatcccaagagccgggaacaaatgatcaatgatcggattggttataaaccccaacccaagcccaataatcgttcatctcaatttggaagtcttgaattttagagatggattatcttgcatgccagagcgctggaatggaataaaatgatggcagaagtacaaaccagatttagagaattgagtgcttgcagtcaagcagaatgtacctcctgcagagacaaatcttctgcatgagattactgatgcttcacttgcactctaagctggaatccaaactctggtttgtctcttgaaaatttgactctataaaactgatctgattttctgtttttaaaaataaat

SEQ ID NO: 362050 - DNA, 1529 bp, Homo sapiens
catgatggaagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttcgttgggggggagccgaggttccgggaaggggctaggccggcttgaaaagagattatgactgtaccttttaactttgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggaggtgcacccagtcctgcagttcaaagcctggcaagactcaccatcatcttcctcctcctcatactgctaatgagaatcagcagctgtgtttctacagtgataatctgcgtatgcatgttcgtgatgttccaatcaccaaaaaggctattgattttaggattcctgagtacctacaaaagctacttaaacatccaggataaaatcagctccacccaagaatacaagataagagttcaaatattcccttggccattttttttttttaaagaaaaggctggaaggacatgtcataaacacctagaaagattctgcagtgagactgctttgcaagtgactttaagtattcattccatgttaaaaataccatagataatgtaagccaggggctagcaagctctttctgttaaacatttagatgtttcagtgctgcaatcacagtgaccggtgttggggagagggattagaaagtgccatggtacttaatccagttactcccccaacacctccaagaggtagccaagttcacacactaaacagagctactgcaacagttctagtgctagtccttagattctagttccagttccggttctagtgcttagattccagttgcatcattccaactgtgagccttcgctgctttaacatctttgccaggaggtgcaaagttctctgggagggagctaccaatcatttcatttcaatttcatactgacagattgaaacattcacgtaagggacacctgtagtaccaacctgactgtgaggggaagcccaagaactccagtgagtctgtggacgctacgctgggacactatctccttagccacaccttgtctaagccaggactaccccaggattgtttcgagaatgataccaggttaaccaaagaaatacttatgtaagatacagatagggtggaaactggaggcagaggagtccgccacaattgatgttgatttagggctgtcgcaggaagacccagggaaacccacgccaaagttggggtggggatgtgtctgcctccaaagtatcctcctttccatcacccaccgccagaatatcttagctcttctgcacctcatccgcgtaga

SEQ ID NO: 362051 - DNA, 674 bp, Homo sapiens
  misc_feature (634)..(634): n is a, c, g, or t
cgagctcggtaccccaccactctatagatcagtcactcctatagatcagtgtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagacccgtaagaaacagaaggaagatgtggaagttgtaggaggcagtgatggagaaggagccattgggcttagcagtgatcccaagagccgggaacaaatgatcaatgatcggattggttataaaccccaacccaagcccaataatcgttcatctcaatttggaagtcttgaattttagagatggattatcttgcatgccagagcgctggaatggaataaaatgatggcagaagtacaaaccagatttagagaattgagtgcttgcagtcaagcagaatgtacctcctgcagagacaaatcttctgcatgagattactgatgcttcacttgcactctaagctggaatccaaactctggtttgtctcttgaaaatttgactctataaaaataggagnggtacgagctcgaatcgtatctggtctaggtcggggggga

SEQ ID NO: 362052 - DNA, 965 bp, Homo sapiens
attcgcggccgcgtcgacgcttttgtaggtactcaggaatcctacaaaagctacttaaacatccaggataaaatcagctccacccaagaatacaagataagagttcaaatattcccttggccattttttttttttaaagaaaaggctggaaggacatgtcataaacacctagaaagattctgcagtgagactgctttgcaagtgactttaagtattcattccatgttaaaaataccatagataatgtaagccaggggctagcaagctctttctgttaaacatttagatgtttcagtgctgcaatcacagtgaccggtgttggggagagggattagaaagtgccatggtacttaatccagttactcccccaacacctccaagaggtagccaagttcacacactaaacagagctactgcaacagttctagtgctagtccttagattctagttccagttccggttctagtgcttagattccagttgcatcattccaactgtgagccttcgctgctttaacatctttgccaggaggtgcaaagttctctgggagggagctaccaatcatttcatttcaatttcatactgacagattgaaacattcacgtaagggacacctgtagtaccaacctgactgtgaggggaagcccaagaactccagtgagtctgtggacgctacgctgggacactatctccttagccacaccttgtctaagccaggactaccccaggattgtttcgagaatgataccaggttaaccaaagaaatacttatgtaagatacagatagggtggaaactggaggcagaggagtccgccacaattgatgttgatttagggctgtcgcaggaagacccagggaaacccacgccaaagttggggtggggatgtgtctgcctccaaagtatcctcctttccatcacccaccgccagaatatcttagctcttctgcacctcatccgcgtaga

SEQ ID NO: 362053 - DNA, 751 bp, Homo sapiens
gacctcggtacccgaattcggctctctgggaaggggctaggccggcttgaaaagattatgactgtaccttttaactttgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagacccgtaagaaacagaaggaagatgtggaagttgtaggaggcagtgatggagaaggagccattgggcttagcagtgatcccaagagccgggaacaaatgatcaatgatcggattggttataaaccccaacccaagcccaataatcgttcatctcaatttggaagtcttgaattttagagatggattatcttgcatgccagagcgctggaatggaataaaatgatggcagaagtacaaaccagatttagagaattgagtgcttgcagtcaagcagaatgtacctcctgcagagacaaatcttctgcatgagattactgatgcttcacttgcactctaagctggaatccaaactctggtttgtctcttgaaaatttgactctataaaatctaattgtcttctctttaattaatttgcgtccccttttggcctagcgtctcttaatttcgtaaagttatcattgcgac

SEQ ID NO: 362054 - DNA, 870 bp, Homo sapiens
  misc_feature (830)..(830): n is a, c, g, or t
catgatggaagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttcgttgggggggagccgaggttccgggaaggggctaggccggcttgaaaagagattatgactgtaccttttaactttgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagacccgtaagaaacagaaggaagatgtggaagttgtaggaggcagtgatggagaaggagccattgggcttagcagtgatcccaagagccgggaacaaatgatcaatgatcggattggttataaaccccaacccaagcccaataatcgttcatctcaatttggaagtcttgaattttagagatggattatcttgcatgccagagcgctggaatggaataaaatgatggcagaagtacaaaccagatttagagaattgagtgcttgcagtcaagcagaatgtacctcctgcagagacaaatcttctgcatgagattactgatgcttcacttgcactctaagctggaatccaaactctggtttgtctcttgaaaatttgactctataaaaataggagnggtacgagctcgaatcgtatctggtctaggtcggggggga

SEQ ID NO: 362055 - DNA, 768 bp, Homo sapiens
catgatggaagtcgtagtaggaaatggcgtcgtggcattgaggggcatccctcctagaacctccaggaaaagctcgcggaagacgaggttctgcggagagagaggctccaagcagtctgattatgactgtaccttttaactttgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagacccgtaagaaacagaaggaagatgtggaagttgtaggaggcagtgatggagaaggagccattgggcttagcagtgatcccaagagccgggaacaaatgatcaatgatcggattggttataaaccccaacccaagcccaataatcgttcatctcaatttggaagtcttgaattttagagatggattatcttgcatgccagagcgctggaatggaataaaatgatggcagaagtacaaaccagatttagagaattgagtgcttgcagtcaagcagaatgtacctcctgcagagacaaatcttctgcatgagattactgatgcttcacttgcactctaagctggaatccaaactctggtttgtctcttgaaaatttgactctataaaactgatctgattttctgtttttaaaaataaat

SEQ ID NO: 362056 - DNA, 703 bp, Homo sapiens
gacctcggtacccgaattcggctctctgggaaggggctaggccggcttgaaaagattatgactgtaccttttaactttgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagacccgtaagaaacagaaggaagatgtggaagttgtaggaggcagtgatggagaaggagccattgggcttagcagtgatcccaagagccgggaacaaatgatcaatgatcggattggttataaaccccaacccaagcccaataatcgttcatctcaatttggaagtcttgaattttagagatggattatcttgcatgccagagcgctggaatggaataaaatgatggcagaagtacaaaccagatttagagaattgagtgcttgcagtcaagcagaatgtacctcctgcagagacaaatcttctgcatgagattactgatgcttcacttgcactctaagctggaatccaaactctggtttgtctcttgaaaatttgactctataaaactgatctgattttctgtttttaaaaataaat

SEQ ID NO: 362057 - DNA, 875 bp, Homo sapiens
tgctacgttaccaaagctgtacttgagcctccttgtgcattcttctctctgcctgaccttcagaagtcaactaagacatcattttctccaggaaggcttgcctgacatccttgtccaccccacactcagcccagactggattaggtgcctgtgtgatgccagtgctagtatcctcatcagggttctcattacatgatatcacagttttctctttgttttccccacaattatgactgtaccttttaactttgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagacccgtaagaaacagaaggaagatgtggaagttgtaggaggcagtgatggagaaggagccattgggcttagcagtgatcccaagagccgggaacaaatgatcaatgatcggattggttataaaccccaacccaagcccaataatcgttcatctcaatttggaagtcttgaattttagagatggattatcttgcatgccagagcgctggaatggaataaaatgatggcagaagtacaaaccagatttagagaattgagtgcttgcagtcaagcagaatgtacctcctgcagagacaaatcttctgcatgagattactgatgcttcacttgcactctaagctggaatccaaactctggtttgtctcttgaaaatttgactctataaaactgatctgattttctgtttttaaaaataaat

SEQ ID NO: 362058 - DNA, 811 bp, Homo sapiens
catgatggaagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttcgttgggggggagccgaggttccgggaaggggctaggccggcttgaaaagaggtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagacccgtaagaaacagaaggaagatgtggaagttgtaggaggcagtgatggagaaggagccattgggcttagcagtgatcccaagagccgggaacaaatgatcaatgatcggattggttataaaccccaacccaagcccaataatcgttcatctcaatttggaagtcttgaattttagagatggattatcttgcatgccagagcgctggaatggaataaaatgatggcagaagtacaaaccagatttagagaattgagtgcttgcagtcaagcagaatgtacctcctgcagagacaaatcttctgcatgagattactgatgcttcacttgcactctaagctggaatccaaactctggtttgtctcttgaaaatttgactctataaaactgatctgattttctgtttttaaaaataaat

SEQ ID NO: 362059 - DNA, 657 bp, Homo sapiens
cgagctcggtaccccaccactctatagatcagtcactcctatagatcagtgtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagacccgtaagaaacagaaggaagatgtggaagttgtaggaggcagtgatggagaaggagccattgggcttagcagtgatcccaagagccgggaacaaatgatcaatgatcggattggttataaaccccaacccaagcccaataatcgttcatctcaatttggaagtcttgaattttagagatggattatcttgcatgccagagcgctggaatggaataaaatgatggcagaagtacaaaccagatttagagaattgagtgcttgcagtcaagcagaatgtacctcctgcagagacaaatcttctgcatgagattactgatgcttcacttgcactctaagctggaatccaaactctggtttgtctcttgaaaatttgactctataaaactgatctgattttctgtttttaaaaataaat

SEQ ID NO: 362060 - DNA, 984 bp, Homo sapiens
catgatggaagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttcgttgggggggagccgaggttccgggaaggggctaggccggcttgaaaagagattatgactgtaccttttaactttgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagtgcattctgcatccagtatcaagaatgatcttcagaaattttcaaatcctgtcattcccgtttaaaactcctcagtagttttctgcacttataacaaaatctgaattcttcaccatggcctacaagattttacccgtaagaaacagaaggaagatgtggaagttgtaggaggcagtgatggagaaggagccattgggcttagcagtgatcccaagagccgggaacaaatgatcaatgatcggattggttataaaccccaacccaagcccaataatcgttcatctcaatttggaagtcttgaattttagagatggattatcttgcatgccagagcgctggaatggaataaaatgatggcagaagtacaaaccagatttagagaattgagtgcttgcagtcaagcagaatgtacctcctgcagagacaaatcttctgcatgagattactgatgcttcacttgcactctaagctggaatccaaactctggtttgtctcttgaaaatttgactctataaaactgatctgattttctgtttttaaaaataaat

SEQ ID NO: 362061 - DNA, 772 bp, Homo sapiens
catgatggaagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttcgttgggggggagccgaggttccgggaaggggctaggccggcttgaaaagagattatgactgtaccttttaactttgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagtgcattctgcatccagtatcaagaatgatcttcagaaattttcaaatcctgtcattcccgtttaaaactcctcagtagttttctgcacttataacaaaatctgaattcttcaccatggcctacaagattttgtatgttctagtgcctctccagattcattttgtgccattctttgccttgctctctataccctagccacattggctctctttcatttccttgaacatgccaatctatttatcacttccatggactttccacatattatttccccctgcctggagtgctccctttcttccagtcttcattcaaatgtcaactcttcaatttaagagg

SEQ ID NO: 362062 - DNA, 606 bp, Homo sapiens
aggggttacaacttttaacaccatatcctcattgtgcccctaagtactccaaacctaggatttcagtttattgttctttacaccctaactctatcatttagcccatgcctagtacatggtaggtgttctaaataaacatttgctaattgaaagaatgttgccttaatcctaaaacttttatactttcagacccgtaagaaacagaaggaagatgtggaagttgtaggaggcagtgatggagaaggagccattgggcttagcagtgatcccaagagccgggaacaaatgatcaatgatcggattggttataaaccccaacccaagcccaataatcgttcatctcaatttggaagtcttgaattttagagatggattatcttgcatgccagagcgctggaatggaataaaatgatggcagaagtacaaaccagatttagagaattgagtgcttgcagtcaagcagaatgtacctcctgcagagacaaatcttctgcatgagattactgatgcttcacttgcactctaagctggaatccaaactctggtttgtctcttgaaaatttgactctataaaactgatctgattttctgtttttaaaaataaat

SEQ ID NO: 362063 - DNA, 889 bp, Homo sapiens
catgatggaagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttcgttgggggggagccgaggttccgggaaggggctaggccggcttgaaaagagattatgactgtaccttttaactttgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagacccgtaagaaacagaaggaagatgtggaagttgtaggaggcagtgatggagaaggagccattgggcttagcagtgatcccaagagccgggaacaaatgatcaatgatcggattggttataaaccccaacccaagcccaataatcgttcatctcaatttggaagtcttgaattttagagatggattatcttgcatgccagagcgctggaatggaataaaatgatggcagaagtacaaaccagatttagagaattgagtgcttgcagtcaagcagaatgtacctcctgcagagacaaatcttctgcatgagattactgatgcttcacttgcactctaagctggaatccaaactctggtttgtctcttgaaaatttgactctataaaattatcctgtttctgttttacaaatgcggtgtgccggttttgttctgtgggtgtgtggctgtgtggtg

SEQ ID NO: 362064 - DNA, 771 bp, Homo sapiens
catgatggaagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttcgttgggggggagccgaggttccgggaaggggctaggccggcttgaaaagagattatgactgtaccttttaactttgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggaggcataaagaccagaacccctaattcagaaaagagtcgatttcagaagggaccaccaaagaaagaagcctaaaatcttggttctggtgtgactctagatggaatcttgctatgttgcccaggctggaatgcaatggctattcacaggcatgatcccactactgatcagtacaggagttttgacctgctccatttctgatctaggctggttcaccaggcaacctggtggttccctgctcctgggcttgtttcttggtaaatactttgtctatatggaatgcatctaataaatgaatgctctcctaaaaaacaaaacaacaacaacaaacaaaacaaa

SEQ ID NO: 362065 - DNA, 560 bp, Homo sapiens
catgatggaagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttcgttgggggggagccgaggttccgggaaggggctaggccggcttgaaaagagattatgactgtaccttttaactttgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggaggtatgaatacaactttgtgtttttttgagatggagtctcgctctgtcacacaggctggagtgcagtggcatgatcttggcccactgcaacctctgcctcctctgcctcagcattcctcgcaaca

SEQ ID NO: 362066 - DNA, 580 bp, Homo sapiens
catgatggaagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttcgttgggggggagccgaggttccgggaaggggctaggccggcttgaaaagagattatgactgtaccttttaactttgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggaggtatgaatacaactttgtgtttttttgagatggagtctcgctctgtcacacaggctggagtgcagtggcatgatcttggcccactgcaacctttcgaactcctgggctcaagcaatccacttgcctcagtctcccaagtagctg

SEQ ID NO: 362067 - DNA, 5653 bp, Homo sapiens
  misc_feature (1076)..(1076): n is a, c, g, or t
  misc_feature (1139)..(1139): n is a, c, g, or t
  misc_feature (1185)..(1185): n is a, c, g, or t
  misc_feature (2577)..(2577): n is a, c, g, or t
cttgctgttaatgaacttggttaaacatggtcaagtgtatgtatgtatatattatcagtactggccttctctatctaagaggaatagcaagaaatttagagacattatttggacattgatttctactaactccactgaattagattcagccttcactttttgggaaatgcacggacactgggaaagatgaaatgaagaagttttccagcatgatgttcttgtctttggagcttagccttacttaggtcttagaacaaaaacaagtcggtagttattagttactgtatctcattttccaaaacacacgtttctttgttacagtcatttacacatatttttgcatgccacatttttgcttttgagcttttgctgaatcactaaatgaccacctttcatgttcctaatgtattaaaattatcagaggattctttgaggattaaatgtgtcagtaagggtattattttgaacaatgcgtaaaaggtgaaggccagctgaagaggcctttttgttgtgaacagaataatatactggaatctgaggactgcactgttatgaatggattatttggctatggaaagaagttatttttaggcacagcatccctataagccctgaagctatgtgttttacaaactagaaattatgcactaaataaaaattaccagatgtcagtctctgtatgtgccaaatggcaaatgtgtaatggttcagagcctggaagaaatgatgcttatttctttgccattcaaactcaaaagggatagctgaggtagagtgctgttgaaaaaattgcagtgtttccagctacccaaagatgttacgaattgttatctgaaaggctttcattctttcccctcatggctcgttgtgtgtttgtggcattacaaatgtaacccacatatttattctaatttattacattctttcctgaggctcctcttgttcttttaaagggtcagcagataacttattttaagaatcaacctggacacagtattctaacaaaggtccaatacagagctaaataaataataggagtcatagccagacacagtgactcacgcctgtaatcccancattttgggaggccaaggcgggtggattacctggtggtgcatgcctgtagtctcagctactcnggaggctgaggcaggagaatcacttgaacccgggacgcagaggttncagtgaaccgagattgcgccactgcactccagcctgggcaacagagcgagacctctatctcaaaaataaataaataaatacatttaaaatatatatatatatatatatatatatatatatatatatatatatatatatttatatatatttcgtgacttatatcttgcacataccagcatacctcattaattttaatgtaaccatccattggcttctcttctctccttagaaattcgagctcaactggtagaacaacaaaaatgcctggagcagcaaacggagatgcgagttcagcttctccaggatctgcaagatttcttccgaaaaaaagctgaaattgagacggaatattcccggaatctagagaagttagcagaaaggttcatggcaaaaacaagaagcactaaggatcatcaacaatacaagaaagaccagaacctgttgtctccagtgaactgctggtatttgctcctgaaccaagtaaggagagaaagcaaagaccatgcaaccttgagtgacatctatctgaacaatgtgattatgcggttcatgcagataagtgaggattctaccaggatgtttaaaaagagcaaagagattgcattccaacttcatgaggatttaatgaaggttcttaatgagctttatacggtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggttaagaaaacgactgaagccaccttgcagacgatacaagatatggtcaccatcgaggactatgatgtttctgaatgcttccagcacagtcgttccacagaatcngtgaagtccactgtctctgaaacctacctgagtaaacccagcatcgccaagagaagagccaaccagcaggaaactgaacagttctacttcatgaaactcagagaatatttggaaggcagtaatctcatcacaaaacttcaagccaaacatgacttgctgcagaggaccctgggagaaggtcatagagctgaatatatgactacaagccgaggacgaagaaactcgcacacaagacatcaggactcaggacaggttattcccctcattgtggaaagctgtattcggttcatcaatctctatggtcttcagcatcaggggattttcagagtgtctggttcccaggtggaagtcaatgatattaaaaattcatttgagagaggtgaaaatcctttggctgatgaccagagtaaccatgatattaactcagttgctggcgttctgaagctctatttccgtgggctggaaaaccccctctttcctaaggaaagatttaacgatctgatttcttgtatcagaatagataatctctatgagagggcgcttcacatccgcaaactcctcctgactttgcccaggtcggtccttatagtgatgaggtacctctttgccttcctcaatcatctatcacagtacagcgatgagaatatgatggacccttataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatgaatgtgagccaatagaagcaatagccaagtttgactatgttgggcggtctgccagagaactatccttcaagaagggtgcctccctgctgctgtatcaccgtgcatctgaggactggtgggaaggcaggcacaacgggattgacgggctggtgcctcaccagtatatagtggtgcaggatatggatgatacgttttcagacactctgagccaaaaagccgacagtgaggccagcagtgggccagtcacggaagacaagtcctcatccaaggacatgaactccccgacagaccgtcatcctgacggctatttagccaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaagcctccagcccttaggccaaaacctgctgttcttccaaaaacaaatcctaccataggacctgccccacctccccagggtccaacagacaagtcatgcacaatgtaaaaaccagccaagcaaggccataaagggaggtgacttaaaaaagaaaatggattagtgacaaaagtcactgatccataactttccttagttttgtgcttataactggagatcttttggcttttctatgttgtcgaatgtaatgtctgagactagctaaattaacacgggcatttgtattttgtaatttttttaaataactggacatatgtcattttaaggacaatagaaacacttagacttacttgaaaatccaatgctgcaccacttgtaatgaaggcaacaccgctctccacattgtacagagcttcaggtttaatgtagcccagctgagtcagaaaggttgtgacctgaaggcagaagaacccgaatgccacacctcattggagtatagccagtgttggtctgtggcacttgggctgaaaggtgataatggcattgcgtggtagctgacaatgagcaccttcggttccatgtggagcggggtttagctcatgcaaaagacttgcaattgtctccatgggacgatcccagtgggactgtcagcccacagctcgagtgggttggatgcttgcctctttcctaacagttatttccccgggtccagcttaaagactcgatggaaggaggtagaacctctgctgttactgcttgaacttaacctgggaaaggagaggaagacaccatctccaaagctattaatgtcactccttttgcgagcatgattaggccccggagatttccaagtccccccatctacacttacaaacgattagaagggtttaattttaaagactttctggttacactactccacgaactcctccaaagatccgttattcaataactgcctagaaaatgtttccatctcctctaaatccctgtgttctcctctgtggaaatgaaggcagcaagaagcacctgaggccttggttcatgcagtgttctcttttgactaaatcacctaggttcctttaaacatgctacaaagcccaggcgtggtggtgcacacctgtactcccagctactcgggtggtttacacaggaggatggctttgggcctagtagttcgagtccagcctgggcagcatagtgtgagaccctgtctcttaaaaaaaaa

SEQ ID NO: 362068 - DNA, 468 bp, Homo sapiens
cctcctcctacttctcctctccctcctcccttccctcgggtcggcgctgcctctggattgcctgcgtgtgggagtacaactctgcctctccaaggagaacgggttgtgaccactgaacaaaacttgcccattgaaagcaaacccggaacagctggataatgtccaccccgagccgattcaagaaggacaaagagatcatagccgagtatgaaagtcaagtcaaagaaattcgagctcaactggtagaacaacaaaaatgcctggagcagcaaacggagatgcgagttcagcttctccaggatctgcaagatttcttccgaaaaaaagctgaaattgagacggaatattcccggaatctagagaagttagcagaaaggttcatggcaaaaacaaaccccgcctgtttaccaaaaacatcacctctagcattactagtattagaggcaatgcctgaggaggaggaggagg

SEQ ID NO: 362069 - DNA, 4464 bp, Homo sapiens
  misc_feature (1388)..(1388): n is a, c, g, or t
cctcctcctacttctcctctccctcctcccttccctcgggtcggcgctgcctctggattgcctgcgtgtgggagtacaactctgcctctccaaggagaacgggttgtgaccactgaacaaaacttgcccattgaaagcaaacccggaacagctggataatgtccaccccgagccgattcaagaaggacaaagagatcatagccgagtatgaaagtcaagtcaaagaaattcgagctcaactggtagaacaacaaaaatgcctggagcagcaaacggagatgcgagttcagcttctccaggatctgcaagatttcttccgaaaaaaagctgaaattgagacggaatattcccggaatctagagaagttagcagaaaggttcatggcaaaaacaagaagcactaaggatcatcaacaatacaagaaagaccagaacctgttgtctccagtgaactgctggtatttgctcctgaaccaagtaaggagagaaagcaaagaccatgcaaccttgagtgacatctatctgaacaatgtgattatgcggttcatgcagataagtgaggattctaccaggatgtttaaaaagagcaaagagattgcattccaacttcatgaggatttaatgaaggttcttaatgagctttatacggtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggttaagaaaacgactgaagccaccttgcagacgatacaagatatggtcaccatcgaggactatgatgtttctgaatgcttccagcacagtcgttccacagaatcngtgaagtccactgtctctgaaacctacctgagtaaacccagcatcgccaagagaagagccaaccagcaggaaactgaacagttctacttcatgaaactcagagaatatttggaaggcagtaatctcatcacaaaacttcaagccaaacatgacttgctgcagaggaccctgggagaaggtcatagagctgaatatatgactacaagccgaggacgaagaaactcgcacacaagacatcaggactcaggacaggttattcccctcattgtggaaagctgtattcggttcatcaatctctatggtcttcagcatcaggggattttcagagtgtctggttcccaggtggaagtcaatgatattaaaaattcatttgagagaggtgaaaatcctttggctgatgaccagagtaaccatgatattaactcagttgctggcgttctgaagctctatttccgtgggctggaaaaccccctctttcctaaggaaagatttaacgatctgatttcttgtatcagaatagataatctctatgagagggcgcttcacatccgcaaactcctcctgactttgcccaggtcggtccttatagtgatgaggtacctctttgccttcctcaatcatctatcacagtacagcgatgagaatatgatggacccttataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatgaatgtgagccaatagaagcaatagccaagtttgactatgttgggcggtctgccagagaactatccttcaagaagggtgcctccctgctgctgtatcaccgtgcatctgaggactggtgggaaggcaggcacaacgggattgacgggctggtgcctcaccagtatatagtggtgcaggatatggatgatacgttttcagacactctgagccaaaaagccgacagtgaggccagcagtgggccagtcacggaagacaagtcctcatccaaggacatgaactccccgacagaccgtcatcctgacggctatttagccaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaagcctccagcccttaggccaaaacctgctgttcttccaaaaacaaatcctaccataggacctgccccacctccccagggtccaacagacaagtcatgcacaatgtaaaaaccagccaagcaaggccataaagggaggtgacttaaaaaagaaaatggattagtgacaaaagtcactgatccataactttccttagttttgtgcttataactggagatcttttggcttttctatgttgtcgaatgtaatgtctgagactagctaaattaacacgggcatttgtattttgtaatttttttaaataactggacatatgtcattttaaggacaatagaaacacttagacttacttgaaaatccaatgctgcaccacttgtaatgaaggcaacaccgctctccacattgtacagagcttcaggtttaatgtagcccagctgagtcagaaaggttgtgacctgaaggcagaagaacccgaatgccacacctcattggagtatagccagtgttggtctgtggcacttgggctgaaaggtgataatggcattgcgtggtagctgacaatgagcaccttcggttccatgtggagcggggtttagctcatgcaaaagacttgcaattgtctccatgggacgatcccagtgggactgtcagcccacagctcgagtgggttggatgcttgcctctttcctaacagttatttccccgggtccagcttaaagactcgatggaaggaggtagaacctctgctgttactgcttgaacttaacctgggaaaggagaggaagacaccatctccaaagctattaatgtcactccttttgcgagcatgattaggccccggagatttccaagtccccccatctacacttacaaacgattagaagggtttaattttaaagactttctggttacactactccacgaactcctccaaagatccgttattcaataactgcctagaaaatgtttccatctcctctaaatccctgtgttctcctctgtggaaatgaaggcagcaagaagcacctgaggccttggttcatgcagtgttctcttttgactaaatcacctaggttcctttaaacatgctacaaagcccaggcgtggtggtgcacacctgtactcccagctactcgggtggtttacacaggaggatggctttgggcctagtagttcgagtccagcctgggcagcatagtgtgagaccctgtctcttaaaaaaaaa

SEQ ID NO: 362070 - DNA, 2355 bp, Homo sapiens
cctcctcctacttctcctctccctcctcccttccctcgggtcggcgctgcctctggattgcctgcgtgtgggagtacaactctgcctctccaaggagaacgggttgtgaccactgaacaaaacttgcccattgaaagcaaacccggaacagctggataatgtccaccccgagccgattcaagaaggacaaagagatcatagccgagtatgaaagtcaagtcaaagaaattcgagctcaactggtagaacaacaaaaatgcctggagcagcaaacggagatgcgagttcagcttctccaggatctgcaagatttcttccgaaaaaaagctgaaattgagacggaatattcccggaatctagagaagttagcagaaaggttcatggcaaaaacaagaagcactaaggatcatcaacaatacaagaaagaccagaacctgttgtctccagtgaactgctggtatttgctcctgaaccaagtaaggagagaaagcaaagaccatgcaaccttgagtgacatctatctgaacaatgtgattatgcggttcatgcagataagtgaggattctaccaggatgtttaaaaagagcaaagagattgcattccaacttcatgaggatttaatgaaggttcttaatgagctttatacggtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggtgagcatgcgttcgtcctgccacaccagtaatctgaattcaaatataactggaagacattctcacatgacttgggcatatttaatattcaagattcaacctcttcatcacgtatttcctgctctcagggttcctgtagtactctttgtaggggataaatgcaaagattctgtattctgccatagattaatattttactagacactcaactgcatatacatgtaaacacaattttttttaccttaaattgtaatttatactgaaaatagttcccgtgggttatcaaattcaacatatatatccaaaaatatacaatcttttgtacagtggaacttttgactaacatgttaacttattttaaaaaatattttgtagagatggggccttgctatgttgcccagactggactcaaactgccggcttcaagcagtcctcctgccttggcctcccaaagtgctgggattacaggcatgagccattatggtgcctggcccacagtgtgccatgttaatttaatcctaacttttaaaattcacttctttttttccttatgctttcctatattctctaaattttgtggtactggaacatggcattactgatataattagaacaaaatcatattttcaaatggtacttgaatgaggatagaaaatgtttatttgccagcattactgtatttaaatgaatagaatataaaatatgatttatcaatatatgttgagctaggaagcaattatacaattcagctgcctatttctgaaattaacttacttgaattcacgttctcctaaaataaagatacaaaccacaaatgttcttgcattagtcaaggctcccaattgtaatttacaggaacacaagttaaaaagttaactattggtcagtgtttgcagtatcctcagacatcactggatttgtgttcaaagtggtggccatcacgagtctttcattcactcacagttgagagttattgaggaatgtgcgcaggtaagagtgccgcgatagatcgacatgtcatctggtgcctttgaacgctgatcatctacagatcctcgtacaatcttgatct

SEQ ID NO: 362071 - DNA, 1011 bp, Homo sapiens
cctcctcctacttctcctctccctcctcccttccctcgggtcggcgctgcctctggattgcctgcgtgtgggagtacaactctgcctctccaaggagaacgggttgtgaccactgaacaaaacttgcccattgaaagcaaacccggaacagctggataatgtccaccccgagccgattcaagaaggacaaagagatcatagccgagtatgaaagtcaagtcaaagaaattcgagctcaactggtagaacaacaaaaatgcctggagcagcaaacggagatgcgagttcagcttctccaggatctgcaagatttcttccgaaaaaaagctgaaattgagacggaatattcccggaatctagagaagttagcagaaaggttcatggcaaaaacaagaagcactaaggatcatcaacaatacaagaaagaccagaacctgttgtctccagtgaactgctggtatttgctcctgaaccaagtaaggagagaaagcaaagaccatgcaaccttgagtgacatctatctgaacaatgtgattatgcggttcatgcagataagtgaggattctaccaggatgtttaaaaagagcaaagagattgcattccaacttcatgaggatttaatgaaggttcttaatgagctttatacggtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgatgtgagtacttgaagtttttgtcttttccatattaaaatgaaattaacaataa

SEQ ID NO: 362072 - DNA, 3161 bp, Homo sapiens
attttcccccatcttaagaaaatttgctttgatttccattctcctactagcagcagctgatatcacctgtagacctatgagcattttatctattctatcattgaagttactgataaagatttttgttgttgttgttgttgttgggagaaatggatttcccacaactaatccctctggcccaccattaggagaaggtcatagagctgaatatatgactacaaggcctccaaatgttccccctaagccccagaaacacaggaagtccaggccccgctcacagtataatactaagttgtttaatggggatttggaaacattcgtcaaggactcaggacaggttattcccctcattgtggaaagctgtattcggttcatcaatctctatggtcttcagcatcaggggattttcagagtgtctggttcccaggtggaagtcaatgatattaaaaattcatttgagagaggtgaaaatcctttggctgatgaccagagtaaccatgatattaactcagttgctggcgttctgaagctctatttccgtgggctggaaaaccccctctttcctaaggaaagatttaacgatctgatttcttgtatcagaatagataatctctatgagagggcgcttcacatccgcaaactcctcctgactttgcccaggtcggtccttatagtgatgaggtacctctttgccttcctcaatcatctatcacagtacagcgatgagaatatgatggacccttataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatgaatgtgagccaatagaagcaatagccaagtttgactatgttgggcggtctgccagagaactatccttcaagaagggtgcctccctgctgctgtatcaccgtgcatctgaggactggtgggaaggcaggcacaacgggattgacgggctggtgcctcaccagtatatagtggtgcaggatatggatgatacgttttcagacactctgagccaaaaagccgacagtgaggccagcagtgggccagtcacggaagacaagtcctcatccaaggacatgaactccccgacagaccgtcatcctgacggctatttagccaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaagcctccagcccttaggccaaaacctgctgttcttccaaaaacaaatcctaccataggacctgccccacctccccagggtccaacagacaagtcatgcacaatgtaaaaaccagccaagcaaggccataaagggaggtgacttaaaaaagaaaatggattagtgacaaaagtcactgatccataactttccttagttttgtgcttataactggagatcttttggcttttctatgttgtcgaatgtaatgtctgagactagctaaattaacacgggcatttgtattttgtaatttttttaaataactggacatatgtcattttaaggacaatagaaacacttagacttacttgaaaatccaatgctgcaccacttgtaatgaaggcaacaccgctctccacattgtacagagcttcaggtttaatgtagcccagctgagtcagaaaggttgtgacctgaaggcagaagaacccgaatgccacacctcattggagtatagccagtgttggtctgtggcacttgggctgaaaggtgataatggcattgcgtggtagctgacaatgagcaccttcggttccatgtggagcggggtttagctcatgcaaaagacttgcaattgtctccatgggacgatcccagtgggactgtcagcccacagctcgagtgggttggatgcttgcctctttcctaacagttatttccccgggtccagcttaaagactcgatggaaggaggtagaacctctgctgttactgcttgaacttaacctgggaaaggagaggaagacaccatctccaaagctattaatgtcactccttttgcgagcatgattaggccccggagatttccaagtccccccatctacacttacaaacgattagaagggtttaattttaaagactttctggttacactactccacgaactcctccaaagatccgttattcaataactgcctagaaaatgtttccatctcctctaaatccctgtgttctcctctgtggaaatgaaggcagcaagaagcacctgaggccttggttcatgcagtgttctcttttgactaaatcacctaggttcctttaaacatgctacaaagcccaggcgtggtggtgcacacctgtactcccagctactcgggtggtttacacaggaggatggctttgggcctagtagttcgagtccagcctgggcagcatagtgtgagaccctgtctcttaaaaaaaaa

SEQ ID NO: 362073 - DNA, 2434 bp, Homo sapiens
cctcctcctacttctcctctccctcctcccttccctcgggtcggcgctgcctctggattgcctgcgtgtgggagtacaactctgcctctccaaggagaacgggttgtgaccactgaacaaaacttgcccattgaaagcaaacccggaacagctggataatgtccaccccgagccgattcaagaaggacaaagagatcatagccgagtatgaaagtcaagtcaaagaaattcgagctcaactggtagaacaacaaaaatgcctggagcagcaaacggagatgcgagttcagcttctccaggatctgcaagatttcttccgaaaaaaagctgaaattgagacggaatattcccggaatctagagaagttagcagaaaggttcatggcaaaaacaagaagcactaaggatcatcaacaatacaagaaagaccagaacctgttgtctccagtgaactgctggtatttgctcctgaaccaagtaaggagagaaagcaaagaccatgcaaccttgagtgacatctatctgaacaatgtgattatgcggttcatgcagataagtgaggattctaccaggatgtttaaaaagagcaaagagattgcattccaacttcatgaggatttaatgaaggttcttaatgagctttatacggtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggtgagcatgcgttcgtcctgccacaccagtaatctgaattcaaatataactggaagacattctcacatgacttgggcatatttaatattcaagattcaacctcttcatcacgtatttcctgctctcagggttcctgtagtactctttgtaggggataaatgcaaagattctgtattctgccatagattaatattttactagacactcaactgcatatacatgtaaacacaattttttttaccttaaattgtaatttatactgaaaatagttcccgtgggttatcaaattcaacatatatatccaaaaatatacaatcttttgtacagtggaacttttgactaacatgttaacttattttaaaaaatattttgtagagatggggccttgctatgttgcccagactggactcaaactgccggcttcaagcagtcctcctgccttggcctcccaaagtgctgggattacaggcatgagccattatggtgcctggcccacagtgtgccatgttaatttaatcctaacttttaaaattcacttctttttttccttatgctttcctatattctctaaattttgtggtactggaacatggcattactgatataattagaacaaaatcatattttcaaatggtacttgaatgaggatagaaaatgtttatttgccagcattactgtatttaaatgaatagaatataaaatatgatttatcaatatatgttgagctaggaagcaattatacaattcagctgcctatttctgaaattaacttacttgaattcacgttctcctaaaataaagatacaaaccacaaatgttcttgcattagtcaaggctcccaattgtaatttacaggaacacaagttaaaaagttaactattggtcagtgtttgcagtatcctcagacatcactggatttgtgttcaaatgatgttatcaggactctctctttatcactttgaagtgatttcttcatgtgtgttggtagtgttttcaggatagacgcagaactatgtggtcccttttaaagctttccatcccactccatcctagcattcttgtctctgaagtaggactgactcttcactgacctggctgaagtcatgcatacttctggacaaaccattacatctaggaaatgagattctgtc

SEQ ID NO: 362074 - DNA, 2880 bp, Homo sapiens
  misc_feature (1388)..(1388): n is a, c, g, or t
cctcctcctacttctcctctccctcctcccttccctcgggtcggcgctgcctctggattgcctgcgtgtgggagtacaactctgcctctccaaggagaacgggttgtgaccactgaacaaaacttgcccattgaaagcaaacccggaacagctggataatgtccaccccgagccgattcaagaaggacaaagagatcatagccgagtatgaaagtcaagtcaaagaaattcgagctcaactggtagaacaacaaaaatgcctggagcagcaaacggagatgcgagttcagcttctccaggatctgcaagatttcttccgaaaaaaagctgaaattgagacggaatattcccggaatctagagaagttagcagaaaggttcatggcaaaaacaagaagcactaaggatcatcaacaatacaagaaagaccagaacctgttgtctccagtgaactgctggtatttgctcctgaaccaagtaaggagagaaagcaaagaccatgcaaccttgagtgacatctatctgaacaatgtgattatgcggttcatgcagataagtgaggattctaccaggatgtttaaaaagagcaaagagattgcattccaacttcatgaggatttaatgaaggttcttaatgagctttatacggtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggttaagaaaacgactgaagccaccttgcagacgatacaagatatggtcaccatcgaggactatgatgtttctgaatgcttccagcacagtcgttccacagaatcngtgaagtccactgtctctgaaacctacctgagtaaacccagcatcgccaagagaagagccaaccagcaggaaactgaacagttctacttcatgaaactcagagaatatttggaaggcagtaatctcatcacaaaacttcaagccaaacatgacttgctgcagaggaccctgggagaaggtcatagagctgaatatatgactacaagccgaggacgaagaaactcgcacacaagacatcaggactcaggacaggttattcccctcattgtggaaagctgtattcggttcatcaatctctatggtcttcagcatcaggggattttcagagtgtctggttcccaggtggaagtcaatgatattaaaaattcatttgagagaggtgaaaatcctttggctgatgaccagagtaaccatgatattaactcagttgctggcgttctgaagctctatttccgtgggctggaaaaccccctctttcctaaggaaagatttaacgatctgatttcttgtatcagaatagataatctctatgagagggcgcttcacatccgcaaactcctcctgactttgcccaggtcggtccttatagtgatgaggtacctctttgccttcctcaatcatctatcacagtacagcgatgagaatatgatggacccttataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatgaatgtgagccaatagaagcaatagccaagtttgactatgttgggcggtctgccagagaactatccttcaagaagggtgcctccctgctgctgtatcaccgtgcatctgaggactggtgggaaggcaggcacaacgggattgacgggctggtgcctcaccagtatatagtggtgcaggatatggatgatacgttttcagacactctgagccaaaaagccgacagtgaggccagcagtgggccagtcacggaagacaagtcctcatccaaggacatgaactccccgacagaccgtcatcctgacggctatttagccaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcttacacatagcgacgctcgtagagatgcagcttcattgag

SEQ ID NO: 362075 - DNA, 2425 bp, Homo sapiens
  misc_feature (1388)..(1388): n is a, c, g, or t
cctcctcctacttctcctctccctcctcccttccctcgggtcggcgctgcctctggattgcctgcgtgtgggagtacaactctgcctctccaaggagaacgggttgtgaccactgaacaaaacttgcccattgaaagcaaacccggaacagctggataatgtccaccccgagccgattcaagaaggacaaagagatcatagccgagtatgaaagtcaagtcaaagaaattcgagctcaactggtagaacaacaaaaatgcctggagcagcaaacggagatgcgagttcagcttctccaggatctgcaagatttcttccgaaaaaaagctgaaattgagacggaatattcccggaatctagagaagttagcagaaaggttcatggcaaaaacaagaagcactaaggatcatcaacaatacaagaaagaccagaacctgttgtctccagtgaactgctggtatttgctcctgaaccaagtaaggagagaaagcaaagaccatgcaaccttgagtgacatctatctgaacaatgtgattatgcggttcatgcagataagtgaggattctaccaggatgtttaaaaagagcaaagagattgcattccaacttcatgaggatttaatgaaggttcttaatgagctttatacggtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggttaagaaaacgactgaagccaccttgcagacgatacaagatatggtcaccatcgaggactatgatgtttctgaatgcttccagcacagtcgttccacagaatcngtgaagtccactgtctctgaaacctacctgagtaaacccagcatcgccaagagaagagccaaccagcaggaaactgaacagttctacttcatgaaactcagagaatatttggaaggcagtaatctcatcacaaaacttcaagccaaacatgacttgctgcagaggaccctgggagaaggtcatagagctgaatatatgactacaagccgaggacgaagaaactcgcacacaagacatcaggactcaggacaggttattcccctcattgtggaaagctgtattcggttcatcaatctctatggtcttcagcatcaggggattttcagagtgtctggttcccaggtggaagtcaatgatattaaaaattcatttgagagaggtgaaaatcctttggctgatgaccagagtaaccatgatattaactcagttgctggcgttctgaagctctatttccgtgggctggaaaaccccctctttcctaaggaaagatttaacgatctgatttcttgtatcagaatagataatctctatgagagggcgcttcacatccgcaaactcctcctgactttgcccaggtcggtccttatagtgatgaggtacctctttgccttcctcaatcatctatcacagtacagcgatgagaatatgatggacccttataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatggtatgctctccccttatgctattataaagccagtctttatatccctattgtaaacaattgcttgtattaacattttagaggcaaagcacagtggctcctacctataatccca

SEQ ID NO: 362076 - DNA, 10338 bp, Homo sapiens
ctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttttttaggaatcaatgacttaacagaactcaactgtataaatagtttggtccccttaaatgccaatcttccatattagttttacttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaaattttaggcaaccttctaaatctttttcaccatggatgaaactataacttaaagaataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtg

SEQ ID NO: 362077 - DNA, 10460 bp, Homo sapiens
  misc_feature (781)..(781): n is a, c, g, or t
ctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagtgctgtggtgatatccttatatttgattccttgtgcacatgtgggagaaaatctccaaagaattacctagttttgnttaattcttgagcgatgtatgcaccaaagcacatagaagatacttaaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttttttaggaatcaatgacttaacagaactcaactgtataaatagtttggtccccttaaatgccaatcttccatattagttttacttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaaattttaggcaaccttctaaatctttttcaccatggatgaaactataacttaaagaataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtg

SEQ ID NO: 362078 - DNA, 508 bp, Homo sapiens
tttttttttttacaacttttaacggtttatgatgttaaagtaatgacaaagtaaagtatcttttactattaaaattgctgcatttctaaatggcaggagttgtagcagagatgtaaaattggtgaatgtatttgtacttttaaaccataaagtaattatagatttaatgggtcagaacacattaaagtggaaaaatattatgtaacatgattctcttctaaatgagcgatggtattttttgaaagactatagggacattctgtggagacctaggacttagtattggtatgggatcattttatactattcacattgatcatagaatcatggagctttagagttggaagagcctgatacatcatctagttgaactttggcattttactatctctttccctgtgccttgcctggtttggaaattctggccgtttattgtttaagcaaaacaaagctataatattgtaagattgcttaatttattaaatttttttgtggatatttaaacgaa

SEQ ID NO: 362079 - DNA, 743 bp, Homo sapiens
  misc_feature (743)..(743): n is a, c, g, or t
ctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaaacaaaaatgactaaataaaaagtatatattcacagtaaaaaaaaaaaaaaaaaaaaaaaaaaaaaaaaaaacccccgggcgggcctactatatgccgggggcgcggaaaaaaaggaggaaatagaaaaagggcgcacaacgtgccataaggggttccctcggccccagcttcttttggtcccaaggggggaaactcggccggcccccataaagggaggcgaaatatacgaaatacccaggttcccggatagatcccgcgaggn

SEQ ID NO: 362080 - DNA, 11175 bp, Homo sapiens
ctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttttttaggaatcaatgacttaacagaactcaactgtataaatagtttggtccccttaaatgccaatcttccatattagttttacttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaaattttaggcaaccttctaaatctttttcaccatggatgaaactataacttaaagaataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtgttgtgctctttattgtattttcacagctttgaaaatctgtgcacatactgtttcatagaaaatgtatagcttttgttgtcctatataatggtggttcttttgcacatttagttatttaatattgagaggtcacgaagtttggttattgaatctgttatatactaaattctgtaaagggagatctctcatctcaaaaagaatttacataccaggaagtccatgtgtgtttgtgttagttttggatgtctttgtgtaatccagccccatttcctgtttcccaacagctgtaacactcattttaagtcaagcagggctaccaacccacacttgatagaaaagctgcttaccattcagaagcttccttattacctggcctccaaatgagctgaatattttgtagccttcccttagctatgttcattttccctccattatcataaaatcagatcgatatttatgtgccccaaacaaaactttaagagcagttacattctgtcccagtagcccttgtttcctttgagagtagcatgttgtgaggctatagagacttattctaccagtaaaacaggtcaatccttttacatgtttattatactaaaaattatgttcagggtatttactactttatttcaccagactcagtctcaagtgacttggctatctccaaatcagatctacccttagagaataaacatttttctaccgttattttttttcaagtctataatctgagccagtcccaaaggagtgatcaagtttcagaaatgctttcatcttcacaacattttatatatactattatatggggtgaataaagttttaaatccgaaatatata

SEQ ID NO: 362081 - DNA, 10127 bp, Homo sapiens
ctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttttttaggaatcaatgacttaacagaactcaactgtataaatagtttggtccccttaaatgccaatcttccatattagttttacttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaaattttaggcaaccttctaaatctttttcaccatggatgaaactataacttaaagaataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttcgccaggcgtaggggtcctctaggtcg

SEQ ID NO: 362082 - DNA, 8554 bp, Homo sapiens
ctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttttttaggaatcaatgacttaacagaactcaactgtataaatagtttggtccccttaaatgccaatcttccatattagttttacttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaaattttaggcaaccttctaaatctttttcaccatggatgaaactataacttaaagaataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtg

SEQ ID NO: 362083 - DNA, 10232 bp, Homo sapiens
ctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttttttaggaatcaatgacttaacagaactcaactgtataaatagtttggtccccttaaatgccaatcttccatattagttttacttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaaattttaggcaaccttctaaatctttttcaccatggatgaaactataacttaaagaataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtg

SEQ ID NO: 362084 - DNA, 4744 bp, Homo sapiens
taatttctatatgatgggtttcttttgtaatcctatttgttttatgtgtttcaaaacgatattccaagagaatttataagcttctctacactgccaaaagtgtttatgtcacaagtaagattaaaactcctaatctagaaacttggttgatatagacaatttttgtgtctttaaccatatttcttttgatcaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttttttaggaatcaatgacttaacagaactcaactgtataaatagtttggtccccttaaatgccaatcttccatattagttttacttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaaattttaggcaaccttctaaatctttttcaccatggatgaaactataacttaaagaataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtg

SEQ ID NO: 362085 - DNA, 6884 bp, Homo sapiens
ctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgagctacaaatatttctgtgtcgtaattttaaaaatactgatttaaacataccatacaaacattttagcaacaaaagaaacaaaactacccagtctcacaactctatcatatcaaaatttttttgcaatgtctatttgtccttatccatatatatgtatagtctttttcaaaataaaattgtattgtttatatttgaggtttacaacatggtgttatgggatacatatagatagtaaaatggctactgtagtgaagcagatgaacatatctatcatctcacatagttttttttggtgacaagagcagctaatatcaacttaagaaaaattcctaatacagcagtctttgttgttgaaattgttggataaattaaaactttttggtttctaaagcagttttattgagagataattcacatcctgtacaattcacccatttaaagt

SEQ ID NO: 362086 - DNA, 4383 bp, Homo sapiens
ctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaaattttaggcaaccttctaaatctttttcaccatggatgaaactataacttaaagaataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtg

SEQ ID NO: 362087 - DNA, 6047 bp, Homo sapiens
ctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacagttttgcatttgaataaaatgggtatgcttaaaagcataaaatatttctaattaaaacactgatgctgtcaaaattaaaatcaagaagcaaattgatgaaaaagatatacagcacatatgaataatgcccttaatttgtaaagagcttttatttcagaaaaattatgaatgtgaataaatccataaaagaagatatacaaaattccagagtatttttttaaaaagtatttacccacattaataataaaaggtgtataagtt

SEQ ID NO: 362088 - DNA, 5202 bp, Homo sapiens
ctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtaagagctgaagaatatgaaggtatcctgtttttgtggattcattaatatatattggattctattatgtttcaggcacagtcgtaggggctgaagataaagcagtgaacaagaataacaagatctgtctccaaggagcttatattctagtggaggagagagctgctaatca

SEQ ID NO: 362089 - DNA, 4216 bp, Homo sapiens
ctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaataggtatgattccatctgtaaggactttaaaaagattataacacaccctaggcatgggcacaaacagcagcaacggaacagcaagcaggttgtaaaaaccaggagtgcctgccttagaaagactcgctcacagtcttcctgcaagtttgaaagaaaggccagaaaatgggctaaaactcagaaacctta

SEQ ID NO: 362090 - DNA, 266 bp, Homo sapiens
caagtggaagtggcagtgacaatgatgttgaagtgattaaggtctggaattcaagatctcggggaggtggtgaaggaaatgtggatgaaacaggaaacaatccttctgtttctttaaaactggaagaaagtgagtctaatgaatgttgcctttatcatggaacagtaatttggaaaatgtcatgtcgttagtccttttttcagtcacttacctgactaattgactcaaaggaatctttcctcaattgatgagtctaatcaagtact

SEQ ID NO: 362091 - DNA, 659 bp, Homo sapiens
ctggtttggaaattctggccgtttattgtttaagcaaaacaaagctataatattgtaagattgcttaatttattaaatttttttgtggatatttaaacgaaggtgacaatctgttttcttataggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtaacttattttaaatgttttctattattaaaatagtcacatgaaattcatatagtaaactatttttaattttttttaatttttaatgttttttaaccagtgatgcatatttcagtgggaatatttaatattcacatgtttttagtagctacttaaaaaaatctttatttccccacaaaaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggtaaggtattaatagacagtgacataaag

SEQ ID NO: 362092 - DNA, 10224 bp, Homo sapiens
ctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttttttaggaatcaatgacttaacagaactcaactgtataaatagtttggtccccttaaatgccaatcttccatattagttttacttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaaattttaggcaaccttctaaatctttttcaccatggatgaaactataacttaaagaataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtg

SEQ ID NO: 362093 - DNA, 10887 bp, Homo sapiens
ctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttttttaggaatcaatgacttaacagaactcaactgtataaatagtttggtccccttaaatgccaatcttccatattagttttacttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaaattttaggcaaccttctaaatctttttcaccatggatgaaactataacttaaagaataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtgttgtgctctttattgtattttcacagctttgaaaatctgtgcacatactgtttcatagaaaatgtatagcttttgttgtcctatataatggtggttcttttgcacatttagttatttaatattgagaggtcacgaagtttggttattgaatctgttatatactaaattctgtaaagggagatctctcatctcaaaaagaatttacataccaggaagtccatgtgtgtttgtgttagttttggatgtctttgtgtaatccagccccatttcctgtttcccaacagctgtaacactcattttaagtcaagcagggctaccaacccacacttgatagaaaagctgcttaccattcagaagcttccttattacctggcctccaaatgagctgaatattttgtagccttcccttagctatgttcattttccctccattatcataaaatcagatcgatatttatgtgccccaaacaaaactttaagagcagttacattctgtcccagtagcccttgtttcctttgagatctccgtcgaactgggatcctctgatg

SEQ ID NO: 362094 - DNA, 10051 bp, Homo sapiens
ctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttttttaggaatcaatgacttaacagaactcaactgtataaatagtttggtccccttaaatgccaatcttccatattagttttacttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaaaaaaaaacggggttggggcttgcgtttaaggcgttctccgggggttcaaaagcggagtttacacctttaaccttaacacccgtgctttgggagttgggtgcggtagctggctcaaggagagtggcggcgttttttcttcttgggcgaccagcaccttgtgtgggtacaccttctcccaagggccgcctcttgggtgttgtggtgcgtaacccacggacttctggtggcggggtgtggtggggagtcccccgcgcccttttctccccccaatttttcccctgtggatggaatattctcccctaaataaactcccggggtatttattctaaagcaaatttttatgtgcgctgctcccagtgtgataatcccaaaggttttcattcacacacatggggggcgcgagcggcgccgagggtggtggttttctctttagcaaaaacattgtggacaaacagcgacaccgagtctctctgtgagagcatcatcttctggcgaggacggcgcaggaaccccctcttgggcgccactggttgtccccacggccggcggtttttccccaacccaggcttccaagaacttttttttcacccaccgggttttacacaaacccggggaagtttcccccgtgggcgccctacttttttctccccccagggacgctttgcgtggttgaacactttgtgggcacccccttctaaaaattctttttccccgcgggggtgacactcttattcctctagacgaatcatatctctgacgcggcgtgcgggcgaccacccagcggtctggccaactcacgtctgggccccttggttttacctcgtctcctccacgggacttcggacctattagatgggtcctgggtgttcacatcaggtttcccattttttcgccccaca

SEQ ID NO: 362095 - DNA, 6451 bp, Homo sapiens
ttcgtgatagtcgattcctagaggtatcccctctgcgaatcccacagtactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttttttaggaatcaatgacttaacagaactcaactgtataaatagtttggtccccttaaatgccaatcttccatattagttttacttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaaattttaggcaaccttctaaatctttttcaccatggatgaaactataacttaaagaataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtg

SEQ ID NO: 362096 - DNA, 3224 bp, Homo sapiens
cactgtttgttgcttctacaactttttctcttccttgattaatgaggtcctccagctgttgattactcattgctgacagggctcccaaattgaaaggaatgtaaggagtttgagagttgaaactgacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttttttaggaatcaatgacttaacagaactcaactgtataaatagtttggtccccttaaatgccaatcttccatattagttttacttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaaattttaggcaaccttctaaatctttttcaccatggatgaaactataacttaaagaataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtg

SEQ ID NO: 362097 - DNA, 6598 bp, Homo sapiens
ctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttcgtacttaacggatcagcggaactctaggca

SEQ ID NO: 362098 - DNA, 5860 bp, Homo sapiens
ctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggtaaggtattaatagacagtgacataaagaagcaagttgaataaaaaatgtgtttatattttaacaaatagtaattgcacagctactaagtatctggtctttgttgtggttatccttcaggtttttgccttttagaaaattcttagtatttcaatagaataaaatcacccttaatgtcgccagctgttcagaatttatttgctgagtctgaaagtgtttagggttttaggggataccttgtaaacacttaaaaatgcatcaaatgcctgtgttgcaatcaaagattcttccagctatccaaatattaggtgataacaagagctctctccatatcctgaaaacagtttgtgtctttccaaacttcatgtcattagaagaattgctgcttgcttatctccttttaaggggccatcagtatgaaaggttaatattttcaatactgttgatccttatgtgatagtaatctgatgtgagagccagatgttgatatatttgccacttggaa

SEQ ID NO: 362099 - DNA, 4442 bp, Homo sapiens
ctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaactggaaactctaaaacgcagagtgcctctcctcctccaaaagaacgcagttcctcaccagcaacggaacaaagctggatggagaatgatttgacgagctgagagaagaaggttcagacgatcaattactctgagctacgggaggacattcaaaccaaggcaagaagttgaaacttgaaaaattgaagatgttatagataccatacagagagtgttaaggaatgatgggtgaaaacaaggtcagaatagtgaaatgggagctcgggcgatggtcatgggaaggttcctgcgatgaatgttgtgtggg

SEQ ID NO: 362100 - DNA, 3417 bp, Homo sapiens
ctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaaactggcactgtgctggaataaagatgagacattttttttctttgtttttgattaggctttcctccagttgcaattgttaga

SEQ ID NO: 362101 - DNA, 516 bp, Homo sapiens
ctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaaacaaaaatgactaaataaaaagtatatattcacagt

SEQ ID NO: 362102 - DNA, 369 bp, Homo sapiens
agtctctctctgtggccaccactgctccaggcccatggcaggtactgcctggctactgctgatgttcactcaaagcccaggccctcttcagtcagcttgtgttttgcaggtaatttggaactctgggaaacatctccaaacctcttccacgtctgcaaaatcttgcctttgcggggatggagactggacaaagtgtacaaggaagctccctgcattctttcttacatctgcatgtgaatctacaattatctcaaaaattttccaaagaaaacattccaaggactccgggcttggaactccaagaagagcgactgaatgaggcccttccagcccagctgaatacaactgggtacaaataaaaaatggcgg

SEQ ID NO: 362103 - DNA, 6084 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggcacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 362104 - DNA, 4078 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggcacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 362105 - DNA, 6025 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggcacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggaaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 362106 - DNA, 5941 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggcacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatgggccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 362107 - DNA, 4917 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggcacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 362108 - DNA, 6300 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggcacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccgaaaaaaaaaaaaaacctcgactaacaaaacaagaggcacaaaaaaaaaaaaaacacaaacaaacaaacaacatttgtctttgtggcggccgtcggcgccccccagaacaagtttcgttgacgaaccactcggagggggggcagggggcccgaagatccatcggaacacgtggggtaaggggggtcacacgacaggagcacctgggcacacatggggc

SEQ ID NO: 362109 - DNA, 756 bp, Homo sapiens
catgctgaatcaccagggggtcccacatggctgtcccaactccatcaagctggagtccgagaggtggcaggcaggcgggcaggggcttaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 362110 - DNA, 3888 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggcacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 362111 - DNA, 6042 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggcacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggctttattagagtagctttccacatctgatctctcagcctgagtgcacaagcccatgctgagctgttaactcttggagagcgataagca

SEQ ID NO: 362112 - DNA, 1522 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 362113 - DNA, 3786 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggcacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 362114 - DNA, 3569 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggcacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcagcacgcatcggggggctggggggggtccaccaaaccccattctgggcctttttaaacctccttggggggagc

SEQ ID NO: 362115 - DNA, 3282 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggcacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatgggtggcctcccctcccttttagctggcctacatattgcctcataaaaaaggctgaattctatttggtagtcatttcatggattagctgactttgagtaggtagacttctctattaaagagtaagtcttggaatatgcagctaaaagtccagagactaacctcagaatcttatct

SEQ ID NO: 362116 - DNA, 2061 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcgaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggtgggtccctcttttgggctttgctagtcacccccacagcaggcatacccagacagagcaccctcaaacccgggatgcttccttttcatttattccacacacttgagccacatggccccagaggccaaggtaatgcagttctctgtgatttcaaggattcttccagctctaactttttttttttttttttttgagacggtgtctcactctagcctgggtgacagagcaagactccatctcaaaaaaa

SEQ ID NO: 362117 - DNA, 1346 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggtaatacacaaacatttttacttgaaaagagttgagataatggcccaatgtgaggagtggattgcggatatccagcagtacagcagttataagcgggtaggcaggactatgtctcaccatgcagcagctctcaagcgtcacactgctcagc

SEQ ID NO: 362118 - DNA, 532 bp, Homo sapiens
acaaccccctggtcatgcaccagctgcgctgcaatggtgtgctggagggcatccgcatctgcaggaaaggcttccccaaccgcatcctctacggggacttccggcagaggtgggtatgagggtgcaccagagctcatagaacagggggagccaggctgccctgatgggaatgggatctgcaggtgaccctggaattctatgggcagagcagatcactgcagagcatgggtgactctggacacttccctcctcaggtatcgcatcctgaacccagcggccatccctgagggacagttcattgatagcaggaagggggcagagaagctgctcagctccctggacattgatcacaaccagtacaagtttggcacaccaagacaccaaggtgaggaaaggagactaattaattaaaggaagacatctcttttccattgactcctctgatgcttttcctgttgtaatcatcttagcaaaatctcttacctgtatgctacccctcccagtggaacatctagcaccactcccctcatcc

SEQ ID NO: 362119 - DNA, 2022 bp, Homo sapiens
ctgctgggtgtaggtgagcttgcctcgggtcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 362120 - DNA, 3419 bp, Homo sapiens
  misc_feature (29)..(29): n is a, c, g, or t
tatgactcccgagattctcaggagcatgncaggtgaagggctcctcccatgaatggatggagattaaggagtgtgtgttattcatgcttaattcaccagtgcttagctgagtacctggcataaaatagttactgtggtggcccaagtaataacccccaccgccaccaattgctcatgtcctatgttacacagcaccattacataggaagggggaattaagagtgcagataaaattaatgttgctcatcagctgaccttaaaaccagattatgctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 362121 - DNA, 5947 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggcacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 362122 - DNA, 1596 bp, Homo sapiens
tgaagagtgagccttgtccccgggcagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 362123 - DNA, 4770 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggcacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 362124 - DNA, 4410 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggcacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 362125 - DNA, 3971 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggcacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 362126 - DNA, 6160 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggcacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagagatgcggtttcaccatgttggccaggctggtcttgaactcctgaccttgtgatccactcgcctcagcctcccaaaggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 362127 - DNA, 5413 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggcacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggagtcggatctgacccagctccagtcggaagtggaggaggcagtgcaggagtgcagaaacg

SEQ ID NO: 362128 - DNA, 1945 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcgaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 362129 - DNA, 3275 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggcacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggagaagatggtgtcctcctgcaggagaggattgacctcagctccaagtccaggccctcaggtgggaagaaggat

SEQ ID NO: 362130 - DNA, 1334 bp, Homo sapiens
agagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgc

SEQ ID NO: 362131 - DNA, 6665 bp, Homo sapiens
tattatttgatctagaaattgccctccttttacccctaccatgagccctacaaacaactaacctgccactaatagttatgtcatccctcttattaatcatcatcctagccctaagtctggcctatgagtgactacaaaaaggattagactgagccgaataaaaaaaaaaaaaaaaaaaaaaaaaaaaaaaaaaaaaaaaaaaaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgtttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctaagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatatagtttcttgtcttggactttttttttcttttctttttcttttttttttggctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacctaaaaattatctggcc

SEQ ID NO: 362132 - DNA, 6422 bp, Homo sapiens
agagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgtttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctaagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatatagtttcttgtcttggactttttttttcttttctttttcttttttttttggctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacctaaaaattatctggcc

SEQ ID NO: 362133 - DNA, 6013 bp, Homo sapiens
aaagtatttacagtttatgtgagggtcagtacgttggttcattggcttccttcttatctagttctcgggctgagtttgctaatgtcatagcacttctagtagccttccccttttctctgccacttcccagcttccccaggcagaaagcatctggtcggccccttgattaccaggcatccataagtgaccatcatttaggccagtgcttctcagaatgccaatcacctgggctccactaaaaggcaggttctgaatagctcggcctgggttgactgagattctgcggttccaacaagctcgcaggtgatgctgatgctgccagcccatggaccccacctggagtagtgaggttccttggcactttaagaacatccctcctttacttcacatttatttctactggaaactagcacagacttatgcaagctaaattacgcatgttttctccgtaggatgctctatgtcctgttcctcttactaacaactctggtctggaccattgttctaggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgtttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctaagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatatagtttcttgtcttggactttttttttcttttctttttcttttttttttggctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacctaaaaattatctggcc

SEQ ID NO: 362134 - DNA, 5937 bp, Homo sapiens
agagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgtttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctaagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgagaacatgattcatcttgatgatatttgtctttctgtgcctggcttatatcactta

SEQ ID NO: 362135 - DNA, 5619 bp, Homo sapiens
agagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgtttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctaagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgcaactcctctcaaagggaaccaacgctgacaggtaacagtccctgagccaccgtctgtactattgatggctgcacgttgtatcggtgcggccccctacattttcacgacctgttatgcactgctccttttcgctcggtcaccatcccgaggacttttctcttc

SEQ ID NO: 362136 - DNA, 2032 bp, Homo sapiens
tattatttgatctagaaattgccctccttttacccctaccatgagccctacaaacaactaacctgccactaatagttatgtcatccctcttattaatcatcatcctagccctaagtctggcctatgagtgactacaaaaaggattagactgagccgaataaaaaaaaaaaaaaaaaaaaaaaaaaaaaaaaaaaaaaaaaaaaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagacatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatatagtttcttgtcttggactttttttttcttttctttttcttttttttttggctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacctaaaaattatctggcc

SEQ ID NO: 362137 - DNA, 1054 bp, Homo sapiens
agagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgctcaacaggtcggacagggtaagggtaagggatgtaaccaggagatgccacaggaacgtctgagaggtgttagcaagtcccagaggccagcgcccgactccatttcagcctcgttcagggtggcacggagactcctgctgctgcgtcacgtctgtcatgttcagcactcttcccagacacacagtcttgactaaagattgtcaggatcttgaca

SEQ ID NO: 362138 - DNA, 984 bp, Homo sapiens
agagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcacgaatagcaccagcacgaattcccttagcaccagcacgaattcccttagcaccagcacgaattccctt

SEQ ID NO: 362139 - DNA, 1225 bp, Homo sapiens
agagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggagctggtgcgagtgaggcagccccgaggctctgctcgcaccaccacccaatcctcgcctctcttctgctccagcttctactctctgccctcacctctcccccgaaaaccccctatgtagccaaaggaaggaggtcaggggaacgctcgtcccctccccttccagagaaacacgaacaccagaacaaagcctataccaggcccggcggaaacgcaggaggggacgaggggccgccgggctggccatgcgagcactcgcgtgtgccaacgagcgtggacccaggtccgacgggaccgatgcggcaacacagcgcaacaaggcaccgacgcacggacaccgcacctccctgccagaaccctgcctacaccagtccgaggacgacgctacctaccggcagcggcctccgtactccaacgcagcgtaggcaggcacagggaccatcccaacccctaaccaatgacggcagaaaatgggatgggagacacacctggcgccacgccacgacacacgtcccccgacgacggaaccacgacacgtatagcggacacgaaacgcaaagacgacccatcacagcgaagacttggagccccctatgcaactttcaaacccgttggggagcaccgggcgatcctttaggcggactcggcgagtcttcaccgagaatccaccgagaaaaggttcccccactctttacgccaggcaccacccctggcgggatgaccttggcaactacgaaatagcatacccgtaggagacctgccaaa

SEQ ID NO: 362140 - DNA, 490 bp, Homo sapiens
aaagtatttacagtttatgtgagggtcagtacgttggttcattggcttccttcttatctagttctcgggctgagtttgctaatgtcatagcacttctagtagccttccccttttctctgccacttcccagcttccccaggcagaaagcatctggtcggccccttgattaccaggcatccataagtgaccatcatttaggccagtgcttctcagaatgccaatcacctgggctccactaaaaggcaggttctgaatagctcggcctgggttgactgagattctgcggttccaacaagctcgcaggtgatgctgatgctgccagcccatggaccccacctggagtagtgaggtggagagcccctacacgctgatcgattctcttgttctcatgccatacggtaaatcactgacatcttcacgtgggaggttcagagatggggtgtaccaacactgcctgggaacatgcgaacccggtatacctcgattcgta

SEQ ID NO: 362141 - DNA, 583 bp, Homo sapiens
  misc_feature (9)..(9): n is a, c, g, or t
  misc_feature (46)..(46): n is a, c, g, or t
  misc_feature (95)..(95): n is a, c, g, or t
  misc_feature (100)..(100): n is a, c, g, or t
  misc_feature (112)..(112): n is a, c, g, or t
gccacgccnatgaacggcttgccccaccattatggggtgccctctngccccagcttaccttagctccgccggttgatgtggcgatacattcaccngaacncttgccttgttncccagctcgaattaccctcctaagggacaaagctggagctcacgcgtgcgcccgcttagaactagtgaccccgggctgcaggaatcccggccgcgtcgacacggctgcgagagacgacagagggaaacagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacctaaaaattatctggcc

SEQ ID NO: 362142 - DNA, 5439 bp, Homo sapiens
agagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgtttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctaagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactgcaaagaattccaccaggctgtttggagatcctcatcttggagctttttcaaaagcggggcttcatctgcaaagggccctttatctgaagttgtac

SEQ ID NO: 362143 - DNA, 4695 bp, Homo sapiens
agagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgtttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctaagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctacctttgtttttatctctctaactcaatctttctttttcccatcatgggccgattttccccacttccaattgactcccctcttgca

SEQ ID NO: 362144 - DNA, 1212 bp, Homo sapiens
tattatttgatctagaaattgccctccttttacccctaccatgagccctacaaacaactaacctgccactaatagttatgtcatccctcttattaatcatcatcctagccctaagtctggcctatgagtgactacaaaaaggattagactgagccgaataaaaaaaaaaaaaaaaaaaaaaaaaaaaaaaaaaaaaaaaaaaaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggtaatgaccggccccttcctcccttcctttctgcgattcccgctttcccctggccaacaatatgccttctatcaccactgccagagcaaattcttgggatccagaatgaccccaccaatagaatttacccacttatgggcgatagctcatttaataggaaaccactgtttattttttgtgtgttcctactatgtgcccaggctccgtgcccagcactgaggctacatctgtgaataagatcctcatggagatttgggttggtgagactcatttgcaattgtgtatgcatgtgtgtaggggacgcatggaatattttaattaacagtgataatattttaattaaattccaaatttccaaaaa

SEQ ID NO: 362145 - DNA, 6494 bp, Homo sapiens
agagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgtttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctaagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatatagtttcttgtcttggactttttttttcttttctttttcttttttttttggctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacctaaaaattatctggcc

SEQ ID NO: 362146 - DNA, 333 bp, Homo sapiens
gggtatctgggtgatggtgggtggggcatctgggtagtggtgaggtgcccggggatgaagagggagggaaaatctgtagggaaggggggagcagggaggttggactggtgatgcactaaggacctgggatgctcctgggaggctgcatcctgctttcctcgggggctctgagctgagtttgtccaagtgaggagtgagtatggctgagtaaaaggagtaaaggatcctgctgacacatttctcatccttctaggttgttcttcgtgggctcccgggagggccacctaccggaccttctgtccatgcctctctcgctaaatgcagccttctcgt

SEQ ID NO: 362147 - DNA, 6327 bp, Homo sapiens
tgagcatcctgttggcgccgttccactgggagagtttatgtggccgaggcagacaagtggaattaggccttgctgcaggggacttcatttccttctcagtactggacccatttatgaggaggtggcttatgaaagtgtgatgttcgcgtatttcttgacaggcagtggcgtgatcttggctcactgcaacctccgactccctggttcaagcgattctcctgcctcagcctcctgagtggggattacaggccacagcaaacacaggtgtgcaggaaccgtttgtcatggaagccagggagcctgggaggcccacacccacctaccatcttgtccctaacaccagccagtcccaggtggaagaagatgtcagctcgccacctcaaaggtcctccgaaactatgcagctgaagaaggagatctccctgctgaatggggtcagcctggtggtgggcaacatgatcggctcagggatctttgtctcacccaagggtgtgctggtacacactgcctcctatgggatgtcactgattgtgtgggccattggtgggctcttctctgttgtgggtgccctttgttatgcagagctggggaccaccatcaccaagtcgggagccagctacgcttatattctagaggcctttgggggcttcattgccttcatccgcctgtgggtctcactgctagttgttgagcccaccggtcaggccatcatcgccatcacctttgccaactacatcatccagccgtccttccccagctgtgatcccccatacctggcctgccgtctcctggctgctgcttgcatatgtctgctgacatttgtgaactgtgcctatgtcaagtggggcacacgtgtgcaggacacgttcacttacgccaaggtcgtagcgctcattgccatcattgtcatgggccttgttaaactgtgccagggacactctgagcactttcaggacgcctttgagggttcctcctgggacatgggaaacctctctcttgccctctactctgccctcttctcttactcaggttgggacacccttaattttgtaacagaagaaatcaaaaacccagaaagaaatttgcccttggccattgggatttctatgccaattgtgacgctcatctacatcctgaccaatgtggcctattacacagtgctgaacatttcagatgtccttagcagtgatgctgtggctgtgacatttgctgaccagacgtttggcatgttcagctggaccatccccattgctgttgccctgtcctgctttgggggcctcaatgcatccatctttgcttcatcaaggttgttcttcgtgggctcccgggagggccacctaccggaccttctgtccatgatccacattgagcgttttacacctatccctgctttactgttcaattgcaccatggcactcatctacctcatcgtggaggatgttttccagcttatcaactacttcagcttcagctactggttcttcgtgggcctgtctgttgttggacagctctacctccgctggaaggagcccaagcggccccggcctctcaagctgagcgtgtttttccccatcgtgttctgcatatgctccgtgtttctggtgatagtgcccctcttcactgacaccattaattccctcattggcatcgggattgccctttctggagtccctttctacttcatgggtgtttacctgccagagtcccggaggccattgtttattcggaatgtcctggctgctatcaccagaggcacccagcagctttgcttttgtgtcctgactgagcttgatgtagccgaagaaaaaaaggatgagaggaaaactgactagaggtcagaggtggctttctgaggcctggaaggcaggccaaccagcaaaatcctgataacaagactctgtgggcccaactctcctgaattaaaggagccttttgacccaatcatatagtggggctcagggccagtgctcactcttattggtaagctataggagactcaggatctgggccaacctcaaggtgggggcttcagagggtggggggaagattggggaacggggggaatggtcatttagttttactcctgataggtagatgcagctcttacagatatttacttggtaaagtgcagtggggaagagggaatgctaggttgatagggctggtggcttctgaatttggtatttgaactaggagtccctatagaggggctgctttatgggaagtttttctctgaccaggtacaacacctgactttaaaggcctgaaatgctaccatttcttcctctggctcaaaattcttccctggggagagagttatattcccttatttattgatatttagtccagaacaccagttctaacgaagcatgcgtgtctcttcatctacaggatgcaataggctgattgtatttaaaaatcaaagtacccaaaactgagtccctttgggctcagaaatgtctgtggtattgggtcagactctgaccacagattttatgctgtttagcacaatttctattgagtcttacctgcaacaatgaaccttaaagatttttttactcacgtacctgttacactttagcatacagatagatcatagatcacgttacaagcacttggctcaggtccagcaaggacagatgaacaaattcctgagtcagaagtctgttaatattgctgttttgaaggacaatcctttattttacttgagaccttacatctttgttctagctgacagtaaatctctgggtttctgttacgaactctaagagggctgaaacttctgatattcaggtggatcacctgaattctctcagctgtcaatggcttggagaacatctcatgggcccaagtcatcaaataacctgttcctctctgtaagggcagtgtgagggactgctgtgcagacccaagcaatcccaacctggtgctaggtcatttcacttttctgaaaacctcacatcaggctgcatcctcttctgtccctggcaccaggctttgtttacacttggagccaccttggtgtgggtcaccgggacagtgtactcctctcctgccagcctccccttccccgaggtgtggtggctgcagtctcaggaagagcttggtacttgtggggacttctgttttctccctgtggagatcagtgaagactgggaggaaagctgcttcaacctgagtccggctcttcagcaggctgcacaagtggaagcaactaattctggtgctcaggctgggctctccacccaagttaggcctgctctggcctaatggatcttactgtatgagcaggacggctgcattggattgtacaactgttttgtgatgcccccagacactgtcatcctaggccgagaagaacctgctagcttgacataccccatgggcttatccttaggttttggaattggtcaacagtgaggcagtctcccttcctgaccattcttctccacccagtcacagataagggaataaccttggccatatatttgctcaataaagattgaaggaagcatggtcatagttgccctgggttcagagcataatgcatatgtgaagcatggggtgacattcctactgtcatgggtttgggatttgtaacggcaaattcctgcccgacgacagggtgtcttatgcaaaggctgacttgcctgaacgctaagaacatgacttctgtctgagctaagctggcacccatcccagggctcctctggagctaatcctttaagcaaaatgtgcttgccttttaaagatccctgaccccagctttagctttctccaccagataaccagctaatcccaggaatttgctgccccccaccagtggcttctagggaaagcaaggacctcacatgccaggtgccctagtacttgcttagtgagccatgtcatcctcctttcatttttggatggtgacagcatttttcccctctgtgctggatacagacttctcccaggatcctctctttgggagcgaagccagaggatccctacagcactcaagcttcatggtggaattaatttctgccagctctttgttgtctgtctccttaaatccttttcctggtgtgcttattatcccttttgcagtgagtacagtttattaagttgtcagccctttaatattggggaaacttaatgagtataaatagcagggagcacattgtaacagcacagtgttttgtttttttcacccggttgctgtatgagaatggctttcaatcctttgtttctatgcctacagacagaaagcaagatgtctaatattagacatacaagttgctgcctgttataacggtgaattatacctttgtgcatgcctaggatgtttgttgttttaattagctgcaatatatacggcctgtgtacacagaatttaatcacttcggcaggttgaacaactccatgtagataagagcaagtgtaggcaaaggtttagaaaatggacataaagtcaaagaatgatggcaggtaggatgaaggagagatacttaggaaatcctaaaagaggcggcaagaaggtacctccctgtgtaactcaccttcccccatgacagtgagtaagagacactcacaggctatgagggtacacccctagctgaatgttctgtgttgtttccttagacctgtggtgtccgctgcaacagctactagccacgtgtagctaattacattaaaatgaaataaaattaaaagctcagtttctcagttgcgctaatcacatttcaagtgctcagcagccacccgtgtctactactacacagtgcagacacagaacatatcatcactgcagatagttctactggacaatgttacgctagaataaacaccaaggcagtcagttaaggcagctatggtttggaaaggcatacggacagagtctgcttagaagagatacaagttgttaataaaattgatcctgttgatagtagtttgtttttgtggtgggtgctgtgaagagtaaacattactcagtggaaagctaagttcagaaggtactttgtttttcctcccttgccttaagtccttggtatttataatcaatgctgaaccttctatttcactaccgctccctgttttagatattcagatttaaaaggttttcaaagaattactttcttccatgttcaaagctagattttactaaacacatgtatcacattcatatatattgtttcttggccccactgccaaaggaagtcagtcagtaatttcacaaccgttatcagagtttggaagcagaaatagctgttaactaaaatctcccactgctcagactactttctgccctaatggccattactatccagtctgtattgctacaagggacccactggtaccccttttagattctatcaaaaggaacagggttttcctagaggcaggcagcctggtggtatggcacagcagaagcttactgctaatgaaatgggaacctccccctcccttgtggtttcagcacagaacctgaatgccaggaaaaattcctgggccaagaagctaaagctaaagaaaccttccttttttcaacgtttttttttctttcaaactgtagggtcacttttgattgaggcaaaggggtcctactgtaagtggaaaagactcactcccctaacataagttttcactgtggtgggatggtgccgcccgatatgcttgatatgcttttccttccacatgttaagctaggaaacctaacaggatgtcagcagggcagttaactctggactcagagccctcaagggcatgtggcagaacctcatggacatcacaagaccatcagtctgaatccaggtcgtgggggctgtcatagccgaactccttctgcacatccagagggtacttgctccacatccgctgtctgctgctgcctctttcctcctcactcaggctgttgtagtcagcagagcctagaatgacatcccgggagtggattctaaatgtgattttcctaggctactgcaggagccccttctcttctcagaaaggtctgtttttgttcccgattgtaatgcaaaatccttgctcaataaataaaaaagaatatagaattcttttttttttaaagaaggaatcactttcctatcatctaaaccaagttccttcacactggagtattttgtcacttctcccctccgtggagtattttgtcacttctcccctccgtataggattttttgttgttgtaagagttgtagtcatattgtaaatatttttgtacctttctccttttaacgtgttattgacaaacctccccaaaagaatatgcaattgtttgattcatttctctgttatcagacaccaataaattctttttgttgggccttc

SEQ ID NO: 362148 - DNA, 6240 bp, Homo sapiens
tgagcatcctgttggcgccgttccactgggagagtttatgtggccgaggcagacaagtggaattaggccttgctgcaggggacttcatttccttctcagtactggacccatttatgaggaggtggcttatgaaagtgtgatgttcgcgtatttcttgacaggccacagcaaacacaggtgtgcaggaaccgtttgtcatggaagccagggagcctgggaggcccacacccacctaccatcttgtccctaacaccagccagtcccaggtggaagaagatgtcagctcgccacctcaaaggtcctccgaaactatgcagctgaagaaggagatctccctgctgaatggggtcagcctggtggtgggcaacatgatcggctcagggatctttgtctcacccaagggtgtgctggtacacactgcctcctatgggatgtcactgattgtgtgggccattggtgggctcttctctgttgtgggtgccctttgttatgcagagctggggaccaccatcaccaagtcgggagccagctacgcttatattctagaggcctttgggggcttcattgccttcatccgcctgtgggtctcactgctagttgttgagcccaccggtcaggccatcatcgccatcacctttgccaactacatcatccagccgtccttccccagctgtgatcccccatacctggcctgccgtctcctggctgctgcttgcatatgtctgctgacatttgtgaactgtgcctatgtcaagtggggcacacgtgtgcaggacacgttcacttacgccaaggtcgtagcgctcattgccatcattgtcatgggccttgttaaactgtgccagggacactctgagcactttcaggacgcctttgagggttcctcctgggacatgggaaacctctctcttgccctctactctgccctcttctcttactcaggttgggacacccttaattttgtaacagaagaaatcaaaaacccagaaagaaatttgcccttggccattgggatttctatgccaattgtgacgctcatctacatcctgaccaatgtggcctattacacagtgctgaacatttcagatgtccttagcagtgatgctgtggctgtgacatttgctgaccagacgtttggcatgttcagctggaccatccccattgctgttgccctgtcctgctttgggggcctcaatgcatccatctttgcttcatcaaggttgttcttcgtgggctcccgggagggccacctaccggaccttctgtccatgatccacattgagcgttttacacctatccctgctttactgttcaattgcaccatggcactcatctacctcatcgtggaggatgttttccagcttatcaactacttcagcttcagctactggttcttcgtgggcctgtctgttgttggacagctctacctccgctggaaggagcccaagcggccccggcctctcaagctgagcgtgtttttccccatcgtgttctgcatatgctccgtgtttctggtgatagtgcccctcttcactgacaccattaattccctcattggcatcgggattgccctttctggagtccctttctacttcatgggtgtttacctgccagagtcccggaggccattgtttattcggaatgtcctggctgctatcaccagaggcacccagcagctttgcttttgtgtcctgactgagcttgatgtagccgaagaaaaaaaggatgagaggaaaactgactagaggtcagaggtggctttctgaggcctggaaggcaggccaaccagcaaaatcctgataacaagactctgtgggcccaactctcctgaattaaaggagccttttgacccaatcatatagtggggctcagggccagtgctcactcttattggtaagctataggagactcaggatctgggccaacctcaaggtgggggcttcagagggtggggggaagattggggaacggggggaatggtcatttagttttactcctgataggtagatgcagctcttacagatatttacttggtaaagtgcagtggggaagagggaatgctaggttgatagggctggtggcttctgaatttggtatttgaactaggagtccctatagaggggctgctttatgggaagtttttctctgaccaggtacaacacctgactttaaaggcctgaaatgctaccatttcttcctctggctcaaaattcttccctggggagagagttatattcccttatttattgatatttagtccagaacaccagttctaacgaagcatgcgtgtctcttcatctacaggatgcaataggctgattgtatttaaaaatcaaagtacccaaaactgagtccctttgggctcagaaatgtctgtggtattgggtcagactctgaccacagattttatgctgtttagcacaatttctattgagtcttacctgcaacaatgaaccttaaagatttttttactcacgtacctgttacactttagcatacagatagatcatagatcacgttacaagcacttggctcaggtccagcaaggacagatgaacaaattcctgagtcagaagtctgttaatattgctgttttgaaggacaatcctttattttacttgagaccttacatctttgttctagctgacagtaaatctctgggtttctgttacgaactctaagagggctgaaacttctgatattcaggtggatcacctgaattctctcagctgtcaatggcttggagaacatctcatgggcccaagtcatcaaataacctgttcctctctgtaagggcagtgtgagggactgctgtgcagacccaagcaatcccaacctggtgctaggtcatttcacttttctgaaaacctcacatcaggctgcatcctcttctgtccctggcaccaggctttgtttacacttggagccaccttggtgtgggtcaccgggacagtgtactcctctcctgccagcctccccttccccgaggtgtggtggctgcagtctcaggaagagcttggtacttgtggggacttctgttttctccctgtggagatcagtgaagactgggaggaaagctgcttcaacctgagtccggctcttcagcaggctgcacaagtggaagcaactaattctggtgctcaggctgggctctccacccaagttaggcctgctctggcctaatggatcttactgtatgagcaggacggctgcattggattgtacaactgttttgtgatgcccccagacactgtcatcctaggccgagaagaacctgctagcttgacataccccatgggcttatccttaggttttggaattggtcaacagtgaggcagtctcccttcctgaccattcttctccacccagtcacagataagggaataaccttggccatatatttgctcaataaagattgaaggaagcatggtcatagttgccctgggttcagagcataatgcatatgtgaagcatggggtgacattcctactgtcatgggtttgggatttgtaacggcaaattcctgcccgacgacagggtgtcttatgcaaaggctgacttgcctgaacgctaagaacatgacttctgtctgagctaagctggcacccatcccagggctcctctggagctaatcctttaagcaaaatgtgcttgccttttaaagatccctgaccccagctttagctttctccaccagataaccagctaatcccaggaatttgctgccccccaccagtggcttctagggaaagcaaggacctcacatgccaggtgccctagtacttgcttagtgagccatgtcatcctcctttcatttttggatggtgacagcatttttcccctctgtgctggatacagacttctcccaggatcctctctttgggagcgaagccagaggatccctacagcactcaagcttcatggtggaattaatttctgccagctctttgttgtctgtctccttaaatccttttcctggtgtgcttattatcccttttgcagtgagtacagtttattaagttgtcagccctttaatattggggaaacttaatgagtataaatagcagggagcacattgtaacagcacagtgttttgtttttttcacccggttgctgtatgagaatggctttcaatcctttgtttctatgcctacagacagaaagcaagatgtctaatattagacatacaagttgctgcctgttataacggtgaattatacctttgtgcatgcctaggatgtttgttgttttaattagctgcaatatatacggcctgtgtacacagaatttaatcacttcggcaggttgaacaactccatgtagataagagcaagtgtaggcaaaggtttagaaaatggacataaagtcaaagaatgatggcaggtaggatgaaggagagatacttaggaaatcctaaaagaggcggcaagaaggtacctccctgtgtaactcaccttcccccatgacagtgagtaagagacactcacaggctatgagggtacacccctagctgaatgttctgtgttgtttccttagacctgtggtgtccgctgcaacagctactagccacgtgtagctaattacattaaaatgaaataaaattaaaagctcagtttctcagttgcgctaatcacatttcaagtgctcagcagccacccgtgtctactactacacagtgcagacacagaacatatcatcactgcagatagttctactggacaatgttacgctagaataaacaccaaggcagtcagttaaggcagctatggtttggaaaggcatacggacagagtctgcttagaagagatacaagttgttaataaaattgatcctgttgatagtagtttgtttttgtggtgggtgctgtgaagagtaaacattactcagtggaaagctaagttcagaaggtactttgtttttcctcccttgccttaagtccttggtatttataatcaatgctgaaccttctatttcactaccgctccctgttttagatattcagatttaaaaggttttcaaagaattactttcttccatgttcaaagctagattttactaaacacatgtatcacattcatatatattgtttcttggccccactgccaaaggaagtcagtcagtaatttcacaaccgttatcagagtttggaagcagaaatagctgttaactaaaatctcccactgctcagactactttctgccctaatggccattactatccagtctgtattgctacaagggacccactggtaccccttttagattctatcaaaaggaacagggttttcctagaggcaggcagcctggtggtatggcacagcagaagcttactgctaatgaaatgggaacctccccctcccttgtggtttcagcacagaacctgaatgccaggaaaaattcctgggccaagaagctaaagctaaagaaaccttccttttttcaacgtttttttttctttcaaactgtagggtcacttttgattgaggcaaaggggtcctactgtaagtggaaaagactcactcccctaacataagttttcactgtggtgggatggtgccgcccgatatgcttgatatgcttttccttccacatgttaagctaggaaacctaacaggatgtcagcagggcagttaactctggactcagagccctcaagggcatgtggcagaacctcatggacatcacaagaccatcagtctgaatccaggtcgtgggggctgtcatagccgaactccttctgcacatccagagggtacttgctccacatccgctgtctgctgctgcctctttcctcctcactcaggctgttgtagtcagcagagcctagaatgacatcccgggagtggattctaaatgtgattttcctaggctactgcaggagccccttctcttctcagaaaggtctgtttttgttcccgattgtaatgcaaaatccttgctcaataaataaaaaagaatatagaattcttttttttttaaagaaggaatcactttcctatcatctaaaccaagttccttcacactggagtattttgtcacttctcccctccgtggagtattttgtcacttctcccctccgtataggattttttgttgttgtaagagttgtagtcatattgtaaatatttttgtacctttctccttttaacgtgttattgacaaacctccccaaaagaatatgcaattgtttgattcatttctctgttatcagacaccaataaattctttttgttgggccttc

SEQ ID NO: 362149 - DNA, 5274 bp, Homo sapiens
gggtatctgggtgatggtgggtggggcatctgggtagtggtgaggtgcccggggatgaagagggagggaaaatctgtagggaaggggggagcagggaggttggactggtgatgcactaaggacctgggatgctcctgggaggctgcatcctgctttcctcgggggctctgagctgagtttgtccaagtgaggagtgagtatggctgagtaaaaggagtaaaggatcctgctgacacatttctcatccttctaggttgttcttcgtgggctcccgggagggccacctaccggaccttctgtccatgatccacattgagcgttttacacctatccctgctttactgttcaattgcaccatggcactcatctacctcatcgtggaggatgttttccagcttatcaactacttcagcttcagctactggttcttcgtgggcctgtctgttgttggacagctctacctccgctggaaggagcccaagcggccccggcctctcaagctgagcgtgtttttccccatcgtgttctgcatatgctccgtgtttctggtgatagtgcccctcttcactgacaccattaattccctcattggcatcgggattgccctttctggagtccctttctacttcatgggtgtttacctgccagagtcccggaggccattgtttattcggaatgtcctggctgctatcaccagaggcacccagcagctttgcttttgtgtcctgactgagcttgatgtagccgaagaaaaaaaggatgagaggaaaactgactagaggtcagaggtggctttctgaggcctggaaggcaggccaaccagcaaaatcctgataacaagactctgtgggcccaactctcctgaattaaaggagccttttgacccaatcatatagtggggctcagggccagtgctcactcttattggtaagctataggagactcaggatctgggccaacctcaaggtgggggcttcagagggtggggggaagattggggaacggggggaatggtcatttagttttactcctgataggtagatgcagctcttacagatatttacttggtaaagtgcagtggggaagagggaatgctaggttgatagggctggtggcttctgaatttggtatttgaactaggagtccctatagaggggctgctttatgggaagtttttctctgaccaggtacaacacctgactttaaaggcctgaaatgctaccatttcttcctctggctcaaaattcttccctggggagagagttatattcccttatttattgatatttagtccagaacaccagttctaacgaagcatgcgtgtctcttcatctacaggatgcaataggctgattgtatttaaaaatcaaagtacccaaaactgagtccctttgggctcagaaatgtctgtggtattgggtcagactctgaccacagattttatgctgtttagcacaatttctattgagtcttacctgcaacaatgaaccttaaagatttttttactcacgtacctgttacactttagcatacagatagatcatagatcacgttacaagcacttggctcaggtccagcaaggacagatgaacaaattcctgagtcagaagtctgttaatattgctgttttgaaggacaatcctttattttacttgagaccttacatctttgttctagctgacagtaaatctctgggtttctgttacgaactctaagagggctgaaacttctgatattcaggtggatcacctgaattctctcagctgtcaatggcttggagaacatctcatgggcccaagtcatcaaataacctgttcctctctgtaagggcagtgtgagggactgctgtgcagacccaagcaatcccaacctggtgctaggtcatttcacttttctgaaaacctcacatcaggctgcatcctcttctgtccctggcaccaggctttgtttacacttggagccaccttggtgtgggtcaccgggacagtgtactcctctcctgccagcctccccttccccgaggtgtggtggctgcagtctcaggaagagcttggtacttgtggggacttctgttttctccctgtggagatcagtgaagactgggaggaaagctgcttcaacctgagtccggctcttcagcaggctgcacaagtggaagcaactaattctggtgctcaggctgggctctccacccaagttaggcctgctctggcctaatggatcttactgtatgagcaggacggctgcattggattgtacaactgttttgtgatgcccccagacactgtcatcctaggccgagaagaacctgctagcttgacataccccatgggcttatccttaggttttggaattggtcaacagtgaggcagtctcccttcctgaccattcttctccacccagtcacagataagggaataaccttggccatatatttgctcaataaagattgaaggaagcatggtcatagttgccctgggttcagagcataatgcatatgtgaagcatggggtgacattcctactgtcatgggtttgggatttgtaacggcaaattcctgcccgacgacagggtgtcttatgcaaaggctgacttgcctgaacgctaagaacatgacttctgtctgagctaagctggcacccatcccagggctcctctggagctaatcctttaagcaaaatgtgcttgccttttaaagatccctgaccccagctttagctttctccaccagataaccagctaatcccaggaatttgctgccccccaccagtggcttctagggaaagcaaggacctcacatgccaggtgccctagtacttgcttagtgagccatgtcatcctcctttcatttttggatggtgacagcatttttcccctctgtgctggatacagacttctcccaggatcctctctttgggagcgaagccagaggatccctacagcactcaagcttcatggtggaattaatttctgccagctctttgttgtctgtctccttaaatccttttcctggtgtgcttattatcccttttgcagtgagtacagtttattaagttgtcagccctttaatattggggaaacttaatgagtataaatagcagggagcacattgtaacagcacagtgttttgtttttttcacccggttgctgtatgagaatggctttcaatcctttgtttctatgcctacagacagaaagcaagatgtctaatattagacatacaagttgctgcctgttataacggtgaattatacctttgtgcatgcctaggatgtttgttgttttaattagctgcaatatatacggcctgtgtacacagaatttaatcacttcggcaggttgaacaactccatgtagataagagcaagtgtaggcaaaggtttagaaaatggacataaagtcaaagaatgatggcaggtaggatgaaggagagatacttaggaaatcctaaaagaggcggcaagaaggtacctccctgtgtaactcaccttcccccatgacagtgagtaagagacactcacaggctatgagggtacacccctagctgaatgttctgtgttgtttccttagacctgtggtgtccgctgcaacagctactagccacgtgtagctaattacattaaaatgaaataaaattaaaagctcagtttctcagttgcgctaatcacatttcaagtgctcagcagccacccgtgtctactactacacagtgcagacacagaacatatcatcactgcagatagttctactggacaatgttacgctagaataaacaccaaggcagtcagttaaggcagctatggtttggaaaggcatacggacagagtctgcttagaagagatacaagttgttaataaaattgatcctgttgatagtagtttgtttttgtggtgggtgctgtgaagagtaaacattactcagtggaaagctaagttcagaaggtactttgtttttcctcccttgccttaagtccttggtatttataatcaatgctgaaccttctatttcactaccgctccctgttttagatattcagatttaaaaggttttcaaagaattactttcttccatgttcaaagctagattttactaaacacatgtatcacattcatatatattgtttcttggccccactgccaaaggaagtcagtcagtaatttcacaaccgttatcagagtttggaagcagaaatagctgttaactaaaatctcccactgctcagactactttctgccctaatggccattactatccagtctgtattgctacaagggacccactggtaccccttttagattctatcaaaaggaacagggttttcctagaggcaggcagcctggtggtatggcacagcagaagcttactgctaatgaaatgggaacctccccctcccttgtggtttcagcacagaacctgaatgccaggaaaaattcctgggccaagaagctaaagctaaagaaaccttccttttttcaacgtttttttttctttcaaactgtagggtcacttttgattgaggcaaaggggtcctactgtaagtggaaaagactcactcccctaacataagttttcactgtggtgggatggtgccgcccgatatgcttgatatgcttttccttccacatgttaagctaggaaacctaacaggatgtcagcagggcagttaactctggactcagagccctcaagggcatgtggcagaacctcatggacatcacaagaccatcagtctgaatccaggtcgtgggggctgtcatagccgaactccttctgcacatccagagggtacttgctccacatccgctgtctgctgctgcctctttcctcctcactcaggctgttgtagtcagcagagcctagaatgacatcccgggagtggattctaaatgtgattttcctaggctactgcaggagccccttctcttctcagaaaggtctgtttttgttcccgattgtaatgcaaaatccttgctcaataaataaaaaagaatatagaattcttttttttttaaagaaggaatcactttcctatcatctaaaccaagttccttcacactggagtattttgtcacttctcccctccgtggagtattttgtcacttctcccctccgtataggattttttgttgttgtaagagttgtagtcatattgtaaatatttttgtacctttctccttttaacgtgttattgacaaacctccccaaaagaatatgcaattgtttgattcatttctctgttatcagacaccaataaattctttttgttgggccttc

SEQ ID NO: 362150 - DNA, 3431 bp, Homo sapiens
tgagcatcctgttggcgccgttccactgggagagtttatgtggccgaggcagacaagtggaattaggccttgctgcaggggacttcatttccttctcagtactggacccatttatgaggaggtggcttatgaaagtgtgatgttcgcgtatttcttgacaggccacagcaaacacaggtgtgcaggaaccgtttgtcatggaagccagggagcctgggaggcccacacccacctaccatcttgtccctaacaccagccagtcccaggtggaagaagatgtcagctcgccacctcaaaggtcctccgaaactatgcagctgaagaaggagatctccctgctgaatggggtcagcctggtggtgggcaacatgatcggctcagggatctttgtctcacccaagggtgtgctggtacacactgcctcctatgggatgtcactgattgtgtgggccattggtgggctcttctctgttgtgggtgccctttgttatgcagagctggggaccaccatcaccaagtcgggagccagctacgcttatattctagaggcctttgggggcttcattgccttcatccgcctgtgggtctcactgctagttgttgagcccaccggtcaggccatcatcgccatcacctttgccaactacatcatccagccgtccttccccagctgtgatcccccatacctggcctgccgtctcctggctgctgcttgcatatgtctgctgacatttgtgaactgtgcctatgtcaagtggggcacacgtgtgcaggacacgttcacttacgccaaggtcgtagcgctcattgccatcattgtcatgggccttgttaaactgtgccagggacactctgagcactttcaggacgcctttgagggttcctcctgggacatgggaaacctctctcttgccctctactctgccctcttctcttactcaggttgggacacccttaattttgtaacagaagaaatcaaaaacccagaaagaaatttgcccttggccattgggatttctatgccaattgtgacgctcatctacatcctgaccaatgtggcctattacacagtgctgaacatttcagatgtccttagcagtgatgctgtggctgtgacatttgctgaccagacgtttggcatgttcagctggaccatccccattgctgttgccctgtcctgctttgggggcctcaatgcatccatctttgcttcatcaaggttgttcttcgtgggctcccgggagggccacctaccggaccttctgtccatgatccacattgagcgttttacacctatccctgctttactgttcaattgcaccatggcactcatctacctcatcgtggaggatgttttccagcttatcaactacttcagcttcagctactggttcttcgtgggcctgtctgttgttggacagctctacctccgctggaaggagcccaagcggccccggcctctcaagctgagcgtgtttttccccatcgtgttctgcatatgctccgtgtttctggtgatagtgcccctcttcactgacaccattaattccctcattggcatcgggattgccctttctggagtccctttctacttcatgggtgtttacctgccagagtcccggaggccattgtttattcggaatgtcctggctgctatcaccagaggcacccagcagctttgcttttgtgtcctgactgagcttgatgtagccgaagaaaaaaaggatgagaggaaaactgactagaggtcagaggtggctttctgaggcctggaaggcaggccaaccagcaaaatcctgataacaagactctgtgggcccaactctcctgaattaaaggagccttttgacccaatcatatagtggggctcagggccagtgctcactcttattggtaagctataggagactcaggatctgggccaacctcaaggtgggggcttcagagggtggggggaagattggggaacggggggaatggtcatttagttttactcctgataggtagatgcagctcttacagatatttacttggtaaagtgcagtggggaagagggaatgctaggttgatagggctggtggcttctgaatttggtatttgaactaggagtccctatagaggggctgctttatgggaagtttttctctgaccaggtacaacacctgactttaaaggcctgaaatgctaccatttcttcctctggctcaaaattcttccctggggagagagttatattcccttatttattgatatttagtccagaacaccagttctaacgaagcatgcgtgtctcttcatctacaggatgcaataggctgattgtatttaaaaatcaaagtacccaaaactgagtccctttgggctcagaaatgtctgtggtattgggtcagactctgaccacagattttatgctgtttagcacaatttctattgagtcttacctgcaacaatgaaccttaaagatttttttactcacgtacctgttacactttagcatacagatagatcatagatcacgttacaagcacttggctcaggtccagcaaggacagatgaacaaattcctgagtcagaagtctgttaatattgctgttttgaaggacaatcctttattttacttgagaccttacatctttgttctagctgacagtaaatctctgggtttctgttacgaactctaagagggctgaaacttctgatattcaggtggatcacctgaattctctcagctgtcaatggcttggagaacatctcatgggcccaagtcatcaaataacctgttcctctctgtaagggcagtgtgagggactgctgtgcagacccaagcaatcccaacctggtgctaggtcatttcacttttctgaaaacctcacatcaggctgcatcctcttctgtccctggcaccaggctttgtttacacttggagccaccttggtgtgggtcaccgggacagtgtactcctctcctgccagcctccccttccccgaggtgtggtggctgcagtctcaggaagagcttggtacttgtggggacttctgttttctccctgtggagatcagtgaagactgggaggaaagctgcttcaacctgagtccggctcttcagcaggctgcacaagtggaagcaactaattctggtgctcaggctgggctctccacccaagttaggcctgctctggcctaatggatcttactgtatgagcaggacggctgcattggattgtacaactgttttgtgatgcccccagacactgtcatcctaggccgagaagaacctgctagcttgacataccccatgggcttatccttaggttttggaattggtcaacagtgaggcagtctcccttcctgaccattcttctccacccagtcacagataagggaataaccttggccatatatttgctcaataaagattgaaggaagcatggt

SEQ ID NO: 362151 - DNA, 370 bp, Homo sapiens
ttgtgggttttaagctggtgagaacagagcagaaatctataactcaaggagaatccaatcgttggacaaatttaatgccagcctattctgggctgcaggacaggtatttgtcatcagaagtcattatcacatcatgcgtgagctctcatggtgtctttcttgggagcagtgaaggtctacccacttctatttccctgtgttctatggtgggaactgagacaggcctattgtagttagggctgtgtgcatggcatgctgtccctaaataggaagtgggcagggaaatctggtctaaatagagcctcaccagctcctgccctagactgacatacttgtattctttgccaggccacagcaaacacaggtgtgc

SEQ ID NO: 362152 - DNA, 244 bp, Homo sapiens
gctatcttcacagagaaagttgggtctttctcaatagaaagaacccagggtcaaggggaaggtgagcctccctcaaagacttggaggctagtgaactgttaaatgttaggaaaatcccagtggagacttgataaactttgttcccaaggagaggttggttctaggtagtcctttctcacttgtcctgacagaaatttgcccttggccattgggatttctatgccaattgtgacgctcatctaca

SEQ ID NO: 362153 - DNA, 301 bp, Homo sapiens
ttcctcttcccacgttacttaatctctcaccccctctatttcagctgagcgtgtttttccccatcgtgttctgcatatgctccgtgtttctggtgatagtgcccctcttcactgacaccattaattccctcattggcatcgggattgccctttctggagtccctttctacttcatgggtgtttacctgccagagtcccggaggccattgtttattcggaatgtcctgggtgagcttctctgtgccccattactcactggcggctatgtgtgcatgcgcatgcagaggtggggggtggctaa

SEQ ID NO: 362154 - DNA, 6204 bp, Homo sapiens
ttttttttttttgagaccaagtcttgctctgttgccaggcagtggcgtgatcttggctcactgcaacctccgactccctggttcaagcgattctcctgcctcagcctcctgagtggggattacaggccacagcaaacacaggtgtgcaggaaccgtttgtcatggaagccagggagcctgggaggcccacacccacctaccatcttgtccctaacaccagccagtcccaggtggaagaagatgtcagctcgccacctcaaaggtcctccgaaactatgcagctgaagaaggagatctccctgctgaatggggtcagcctggtggtgggcaacatgatcggctcagggatctttgtctcacccaagggtgtgctggtacacactgcctcctatgggatgtcactgattgtgtgggccattggtgggctcttctctgttgtgggtgccctttgttatgcagagctggggaccaccatcaccaagtcgggagccagctacgcttatattctagaggcctttgggggcttcattgccttcatccgcctgtgggtctcactgctagttgttgagcccaccggtcaggccatcatcgccatcacctttgccaactacatcatccagccgtccttccccagctgtgatcccccatacctggcctgccgtctcctggctgctgcttgcatatgtctgctgacatttgtgaactgtgcctatgtcaagtggggcacacgtgtgcaggacacgttcacttacgccaaggtcgtagcgctcattgccatcattgtcatgggccttgttaaactgtgccagggacactctgagcactttcaggacgcctttgagggttcctcctgggacatgggaaacctctctcttgccctctactctgccctcttctcttactcaggttgggacacccttaattttgtaacagaagaaatcaaaaacccagaaagaaatttgcccttggccattgggatttctatgccaattgtgacgctcatctacatcctgaccaatgtggcctattacacagtgctgaacatttcagatgtccttagcagtgatgctgtggctgtgacatttgctgaccagacgtttggcatgttcagctggaccatccccattgctgttgccctgtcctgctttgggggcctcaatgcatccatctttgcttcatcaaggttgttcttcgtgggctcccgggagggccacctaccggaccttctgtccatgatccacattgagcgttttacacctatccctgctttactgttcaattgcaccatggcactcatctacctcatcgtggaggatgttttccagcttatcaactacttcagcttcagctactggttcttcgtgggcctgtctgttgttggacagctctacctccgctggaaggagcccaagcggccccggcctctcaagctgagcgtgtttttccccatcgtgttctgcatatgctccgtgtttctggtgatagtgcccctcttcactgacaccattaattccctcattggcatcgggattgccctttctggagtccctttctacttcatgggtgtttacctgccagagtcccggaggccattgtttattcggaatgtcctggctgctatcaccagaggcacccagcagctttgcttttgtgtcctgactgagcttgatgtagccgaagaaaaaaaggatgagaggaaaactgactagaggtcagaggtggctttctgaggcctggaaggcaggccaaccagcaaaatcctgataacaagactctgtgggcccaactctcctgaattaaaggagccttttgacccaatcatatagtggggctcagggccagtgctcactcttattggtaagctataggagactcaggatctgggccaacctcaaggtgggggcttcagagggtggggggaagattggggaacggggggaatggtcatttagttttactcctgataggtagatgcagctcttacagatatttacttggtaaagtgcagtggggaagagggaatgctaggttgatagggctggtggcttctgaatttggtatttgaactaggagtccctatagaggggctgctttatgggaagtttttctctgaccaggtacaacacctgactttaaaggcctgaaatgctaccatttcttcctctggctcaaaattcttccctggggagagagttatattcccttatttattgatatttagtccagaacaccagttctaacgaagcatgcgtgtctcttcatctacaggatgcaataggctgattgtatttaaaaatcaaagtacccaaaactgagtccctttgggctcagaaatgtctgtggtattgggtcagactctgaccacagattttatgctgtttagcacaatttctattgagtcttacctgcaacaatgaaccttaaagatttttttactcacgtacctgttacactttagcatacagatagatcatagatcacgttacaagcacttggctcaggtccagcaaggacagatgaacaaattcctgagtcagaagtctgttaatattgctgttttgaaggacaatcctttattttacttgagaccttacatctttgttctagctgacagtaaatctctgggtttctgttacgaactctaagagggctgaaacttctgatattcaggtggatcacctgaattctctcagctgtcaatggcttggagaacatctcatgggcccaagtcatcaaataacctgttcctctctgtaagggcagtgtgagggactgctgtgcagacccaagcaatcccaacctggtgctaggtcatttcacttttctgaaaacctcacatcaggctgcatcctcttctgtccctggcaccaggctttgtttacacttggagccaccttggtgtgggtcaccgggacagtgtactcctctcctgccagcctccccttccccgaggtgtggtggctgcagtctcaggaagagcttggtacttgtggggacttctgttttctccctgtggagatcagtgaagactgggaggaaagctgcttcaacctgagtccggctcttcagcaggctgcacaagtggaagcaactaattctggtgctcaggctgggctctccacccaagttaggcctgctctggcctaatggatcttactgtatgagcaggacggctgcattggattgtacaactgttttgtgatgcccccagacactgtcatcctaggccgagaagaacctgctagcttgacataccccatgggcttatccttaggttttggaattggtcaacagtgaggcagtctcccttcctgaccattcttctccacccagtcacagataagggaataaccttggccatatatttgctcaataaagattgaaggaagcatggtcatagttgccctgggttcagagcataatgcatatgtgaagcatggggtgacattcctactgtcatgggtttgggatttgtaacggcaaattcctgcccgacgacagggtgtcttatgcaaaggctgacttgcctgaacgctaagaacatgacttctgtctgagctaagctggcacccatcccagggctcctctggagctaatcctttaagcaaaatgtgcttgccttttaaagatccctgaccccagctttagctttctccaccagataaccagctaatcccaggaatttgctgccccccaccagtggcttctagggaaagcaaggacctcacatgccaggtgccctagtacttgcttagtgagccatgtcatcctcctttcatttttggatggtgacagcatttttcccctctgtgctggatacagacttctcccaggatcctctctttgggagcgaagccagaggatccctacagcactcaagcttcatggtggaattaatttctgccagctctttgttgtctgtctccttaaatccttttcctggtgtgcttattatcccttttgcagtgagtacagtttattaagttgtcagccctttaatattggggaaacttaatgagtataaatagcagggagcacattgtaacagcacagtgttttgtttttttcacccggttgctgtatgagaatggctttcaatcctttgtttctatgcctacagacagaaagcaagatgtctaatattagacatacaagttgctgcctgttataacggtgaattatacctttgtgcatgcctaggatgtttgttgttttaattagctgcaatatatacggcctgtgtacacagaatttaatcacttcggcaggttgaacaactccatgtagataagagcaagtgtaggcaaaggtttagaaaatggacataaagtcaaagaatgatggcaggtaggatgaaggagagatacttaggaaatcctaaaagaggcggcaagaaggtacctccctgtgtaactcaccttcccccatgacagtgagtaagagacactcacaggctatgagggtacacccctagctgaatgttctgtgttgtttccttagacctgtggtgtccgctgcaacagctactagccacgtgtagctaattacattaaaatgaaataaaattaaaagctcagtttctcagttgcgctaatcacatttcaagtgctcagcagccacccgtgtctactactacacagtgcagacacagaacatatcatcactgcagatagttctactggacaatgttacgctagaataaacaccaaggcagtcagttaaggcagctatggtttggaaaggcatacggacagagtctgcttagaagagatacaagttgttaataaaattgatcctgttgatagtagtttgtttttgtggtgggtgctgtgaagagtaaacattactcagtggaaagctaagttcagaaggtactttgtttttcctcccttgccttaagtccttggtatttataatcaatgctgaaccttctatttcactaccgctccctgttttagatattcagatttaaaaggttttcaaagaattactttcttccatgttcaaagctagattttactaaacacatgtatcacattcatatatattgtttcttggccccactgccaaaggaagtcagtcagtaatttcacaaccgttatcagagtttggaagcagaaatagctgttaactaaaatctcccactgctcagactactttctgccctaatggccattactatccagtctgtattgctacaagggacccactggtaccccttttagattctatcaaaaggaacagggttttcctagaggcaggcagcctggtggtatggcacagcagaagcttactgctaatgaaatgggaacctccccctcccttgtggtttcagcacagaacctgaatgccaggaaaaattcctgggccaagaagctaaagctaaagaaaccttccttttttcaacgtttttttttctttcaaactgtagggtcacttttgattgaggcaaaggggtcctactgtaagtggaaaagactcactcccctaacataagttttcactgtggtgggatggtgccgcccgatatgcttgatatgcttttccttccacatgttaagctaggaaacctaacaggatgtcagcagggcagttaactctggactcagagccctcaagggcatgtggcagaacctcatggacatcacaagaccatcagtctgaatccaggtcgtgggggctgtcatagccgaactccttctgcacatccagagggtacttgctccacatccgctgtctgctgctgcctctttcctcctcactcaggctgttgtagtcagcagagcctagaatgacatcccgggagtggattctaaatgtgattttcctaggctactgcaggagccccttctcttctcagaaaggtctgtttttgttcccgattgtaatgcaaaatccttgctcaataaataaaaaagaatatagaattcttttttttttaaagaaggaatcactttcctatcatctaaaccaagttccttcacactggagtattttgtcacttctcccctccgtggagtattttgtcacttctcccctccgtataggattttttgttgttgtaagagttgtagtcatattgtaaatatttttgtacctttctccttttaacgtgttattgacaaacctccccaaaagaatatgcaattgtttgattcatttctctgttatcagacaccaataaattctttttgttgggccttc

SEQ ID NO: 362155 - DNA, 6154 bp, Homo sapiens
tgagcatcctgttggcgccgttccactgggagagtttatgtggccgaggcagacaagtggaattaggccttgctgcaggggacttcatttccttctcagtactggacccatttatgaggaggtggcttatgaaagtgtgatgttcgcgtatttcttgacaggccacagcaaacacaggtgtgcaggaaccgtttgtcatggaagccagggagcctgggaggcccacacccacctaccatcttgtccctaacaccagccagtcccaggtggaagaagatgtcagctcgccacctcaaaggtcctccgaaactatgcagctgaagaaggagatctccctgctgaatggggtcagcctggtggtgggcaacatgatcggctcagggatctttgtctcacccaagggtgtgctggtacacactgcctcctatgggatgtcactgattgtgtgggccattggtgggctcttctctgttgtgggtgccctttgttatgcagagctggggaccaccatcaccaagtcgggagccagctacgcttatattctagaggcctttgggggcttcattgccttcatccgcctgtgggtctcactgctagttgttgagcccaccggtcaggccatcatcgccatcacctttgccaactacatcatccagccgtccttccccagctgtgatcccccatacctggcctgccgtctcctggctgctgcttgcatatgtctgctgacatttgtgaactgtgcctatgtcaagtggggcacacgtgtgcaggacacgttcacttacgccaaggtcgtagcgctcattgccatcattgtcatgggccttgttaaactgtgccagggacactctgagcactttcaggacgcctttgagggttcctcctgggacatgggaaacctctctcttgccctctactctgccctcttctcttactcaggttgggacacccttaattttgtaacagaagaaatcaaaaacccagaaagaaatttgcccttggccattgggatttctatgccaattgtgacgctcatctacatcctgaccaatgtggcctattacacagtgctgaacatttcagatgtccttagcagtgatgctgtggctgtgacatttgctgaccagacgtttggcatgttcagctggaccatccccattgctgttgccctgtcctgctttgggggcctcaatgcatccatctttgcttcatcaaggttgttcttcgtgggctcccgggagggccacctaccggaccttctgtccatgatccacattgagcgttttacacctatccctgctttactgttcaattgcaccatggcactcatctacctcatcgtggaggatgttttccagcttatcaactacttcagcttcagctactggttcttcgtgggcctgtctgttgttggacagctctacctccgctggaaggagcccaagcggccccggcctctcaagctgagcgtgtttttccccatcgtgttctgcatatgctccgtgtttctggtgatagtgcccctcttcactgacaccattaattccctcattggcatcgggattgccctttctggagtccctttctacttcatgggtgtttacctgccagagtcccggaggccattgtttattcggaatgtcctggctgctatcaccagaggcacccagcagctttgcttttgtgtcctgactgagcttgatgtagccgaagaaaaaaaggatgagaggaaaactgactagaggtcagaggtggctttctgaggcctggaaggcaggccaaccagcaaaatcctgataacaagactctgtgggcccaactctcctgaattaaaggagccttttgacccaatcatatagtggggctcagggccagtgctcactcttattggtaagctataggagactcaggatctgggccaacctcaaggtgggggcttcagagggtggggggaagattggggaacggggggaatggtcatttagttttactcctgataggtagatgcagctcttacagatatttacttggtaaagtgcagtggggaagagggaatgctaggttgatagggctggtggcttctgaatttggtatttgaactaggagtccctatagaggggctgctttatgggaagtttttctctgaccaggtacaacacctgactttaaaggcctgaaatgctaccatttcttcctctggctcaaaattcttccctggggagagagttatattcccttatttattgatatttagtccagaacaccagttctaacgaagcatgcgtgtctcttcatctacaggatgcaataggctgattgtatttaaaaatcaaagtacccaaaactgagtccctttgggctcagaaatgtctgtggtattgggtcagactctgaccacagattttatgctgtttagcacaatttctattgagtcttacctgcaacaatgaaccttaaagatttttttactcacgtacctgttacactttagcatacagatagatcatagatcacgttacaagcacttggctcaggtccagcaaggacagatgaacaaattcctgagtcagaagtctgttaatattgctgttttgaaggacaatcctttattttacttgagaccttacatctttgttctagctgacagtaaatctctgggtttctgttacgaactctaagagggctgaaacttctgatattcaggtggatcacctgaattctctcagctgtcaatggcttggagaacatctcatgggcccaagtcatcaaataacctgttcctctctgtaagggcagtgtgagggactgctgtgcagacccaagcaatcccaacctggtgctaggtcatttcacttttctgaaaacctcacatcaggctgcatcctcttctgtccctggcaccaggctttgtttacacttggagccacttggtacttgtggggacttctgttttctccctgtggagatcagtgaagactgggaggaaagctgcttcaacctgagtccggctcttcagcaggctgcacaagtggaagcaactaattctggtgctcaggctgggctctccacccaagttaggcctgctctggcctaatggatcttactgtatgagcaggacggctgcattggattgtacaactgttttgtgatgcccccagacactgtcatcctaggccgagaagaacctgctagcttgacataccccatgggcttatccttaggttttggaattggtcaacagtgaggcagtctcccttcctgaccattcttctccacccagtcacagataagggaataaccttggccatatatttgctcaataaagattgaaggaagcatggtcatagttgccctgggttcagagcataatgcatatgtgaagcatggggtgacattcctactgtcatgggtttgggatttgtaacggcaaattcctgcccgacgacagggtgtcttatgcaaaggctgacttgcctgaacgctaagaacatgacttctgtctgagctaagctggcacccatcccagggctcctctggagctaatcctttaagcaaaatgtgcttgccttttaaagatccctgaccccagctttagctttctccaccagataaccagctaatcccaggaatttgctgccccccaccagtggcttctagggaaagcaaggacctcacatgccaggtgccctagtacttgcttagtgagccatgtcatcctcctttcatttttggatggtgacagcatttttcccctctgtgctggatacagacttctcccaggatcctctctttgggagcgaagccagaggatccctacagcactcaagcttcatggtggaattaatttctgccagctctttgttgtctgtctccttaaatccttttcctggtgtgcttattatcccttttgcagtgagtacagtttattaagttgtcagccctttaatattggggaaacttaatgagtataaatagcagggagcacattgtaacagcacagtgttttgtttttttcacccggttgctgtatgagaatggctttcaatcctttgtttctatgcctacagacagaaagcaagatgtctaatattagacatacaagttgctgcctgttataacggtgaattatacctttgtgcatgcctaggatgtttgttgttttaattagctgcaatatatacggcctgtgtacacagaatttaatcacttcggcaggttgaacaactccatgtagataagagcaagtgtaggcaaaggtttagaaaatggacataaagtcaaagaatgatggcaggtaggatgaaggagagatacttaggaaatcctaaaagaggcggcaagaaggtacctccctgtgtaactcaccttcccccatgacagtgagtaagagacactcacaggctatgagggtacacccctagctgaatgttctgtgttgtttccttagacctgtggtgtccgctgcaacagctactagccacgtgtagctaattacattaaaatgaaataaaattaaaagctcagtttctcagttgcgctaatcacatttcaagtgctcagcagccacccgtgtctactactacacagtgcagacacagaacatatcatcactgcagatagttctactggacaatgttacgctagaataaacaccaaggcagtcagttaaggcagctatggtttggaaaggcatacggacagagtctgcttagaagagatacaagttgttaataaaattgatcctgttgatagtagtttgtttttgtggtgggtgctgtgaagagtaaacattactcagtggaaagctaagttcagaaggtactttgtttttcctcccttgccttaagtccttggtatttataatcaatgctgaaccttctatttcactaccgctccctgttttagatattcagatttaaaaggttttcaaagaattactttcttccatgttcaaagctagattttactaaacacatgtatcacattcatatatattgtttcttggccccactgccaaaggaagtcagtcagtaatttcacaaccgttatcagagtttggaagcagaaatagctgttaactaaaatctcccactgctcagactactttctgccctaatggccattactatccagtctgtattgctacaagggacccactggtaccccttttagattctatcaaaaggaacagggttttcctagaggcaggcagcctggtggtatggcacagcagaagcttactgctaatgaaatgggaacctccccctcccttgtggtttcagcacagaacctgaatgccaggaaaaattcctgggccaagaagctaaagctaaagaaaccttccttttttcaacgtttttttttctttcaaactgtagggtcacttttgattgaggcaaaggggtcctactgtaagtggaaaagactcactcccctaacataagttttcactgtggtgggatggtgccgcccgatatgcttgatatgcttttccttccacatgttaagctaggaaacctaacaggatgtcagcagggcagttaactctggactcagagccctcaagggcatgtggcagaacctcatggacatcacaagaccatcagtctgaatccaggtcgtgggggctgtcatagccgaactccttctgcacatccagagggtacttgctccacatccgctgtctgctgctgcctctttcctcctcactcaggctgttgtagtcagcagagcctagaatgacatcccgggagtggattctaaatgtgattttcctaggctactgcaggagccccttctcttctcagaaaggtctgtttttgttcccgattgtaatgcaaaatccttgctcaataaataaaaaagaatatagaattcttttttttttaaagaaggaatcactttcctatcatctaaaccaagttccttcacactggagtattttgtcacttctcccctccgtggagtattttgtcacttctcccctccgtataggattttttgttgttgtaagagttgtagtcatattgtaaatatttttgtacctttctccttttaacgtgttattgacaaacctccccaaaagaatatgcaattgtttgattcatttctctgttatcagacaccaataaattctttttgttgggccttc

SEQ ID NO: 362156 - DNA, 1678 bp, Homo sapiens
tgagcatcctgttggcgccgttccactgggagagtttatgtggccgaggcagacaagtggaattaggccttgctgcaggggacttcatttccttctcagtactggacccatttatgaggaggtggcttatgaaagtgtgatgttcgcgtatttcttgacaggccacagcaaacacaggtgtgcaggaaccgtttgtcatggaagccagggagcctgggaggcccacacccacctaccatcttgtccctaacaccagccagtcccaggtggaagaagatgtcagctcgccacctcaaaggtcctccgaaactatgcagctgaagaaggagatctccctgctgaatggggtcagcctggtggtgggcaacatgatcggctcagggatctttgtctcacccaagggtgtgctggtacacactgcctcctatgggatgtcactgattgtgtgggccattggtgggctcttctctgttgtgggtgccctttgttatgcagagctggggaccaccatcaccaagtcgggagccagctacgcttatattctagaggcctttgggggcttcattgccttcatccgcctgtgggtctcactgctagttgttgagcccaccggtcaggccatcatcgccatcacctttgccaactacatcatccagccgtccttccccagctgtgatcccccatacctggcctgccgtctcctggctgctgcttgcatatgtctgctgacatttgtgaactgtgcctatgtcaagtggggcacacgtgtgcaggacacgttcacttacgccaaggtcgtagcgctcattgccatcattgtcatgggccttgttaaactgtgccagggacactctgagcactttcaggacgcctttgagggttcctcctgggacatgggaaacctctctcttgccctctactctgccctcttctcttactcaggttgggacacccttaattttgtaacagaagaaatcaaaaacccagaaagaaatttgcccttggccattgggatttctatgccaattgtgacgctcatctacatcctgaccaatgtggcctattacacagtgctgaacatttcagatgtccttagcagtgatgctgtggctgtgacatttgctgaccagacgtttggcatgttcagctggaccatccccattgctgttgccctgtcctgctttgggggcctcaatgcatccatctttgcttcatcaaggttgttcttcgtgggctcccgggagggccacctaccggaccttctgtccatgatccacattgagcgttttacacctatccctgctttactgttcaattgcaccatggcactcatctacctcatcgtggaggatgttttccagcttatcaactacttcagcttcagctactggttcttcgtgggcctgtctgttgttggacagctctacctccgctggaaggagcccaagcggccccggcctctcaagctgagcgtgtttttccccatcgtgttctgcatatgctccgtgtttctggtgatagtgcccctcttcactgacaccattaattccctcattggcatcgggattgccctttctggagtccctttctacttcatgggtgtttacctgccagagtcccggaggccatttagcggagaaaaagtttacacagggtggacgagatgaacggcaataga

SEQ ID NO: 362157 - DNA, 316 bp, Homo sapiens
tgcagaactgctagtctgttttctaaagtggctgcatagttttacgtttccatcagccgtgtaggaaatatgtggccttttgtaattggcttctttcacttagcataatatgttcaaggtttatccatgttgtggtatgtatcagtacttcattccttttaatggctgaataatgtcccattgcatggatataacacatttatccttcagaaagctttttatccaaaagtattcagtgaagcattagttataattttaaaaaattgaaaattaccttaatttttaacaaaaaagagtcgttaaattaggtacatct

SEQ ID NO: 362158 - DNA, 467 bp, Homo sapiens
gcataatggtttttaattgtttctattctatgtgcatttacatgcattctacaagtaacctttattatttacaaaatcagaacattttgatcaacaaagaaaatgactaaaatatccataatcaggacaattctaatgccatcagatacatctagtaacaagtgaaaggtgagggatctgtgaacacggcttaaccatgttaggcccattctagagagcaggtctgggtagcagagggcaggaacccagagtagattgaatcaggagctaaacagataatgtaaagccagaatattcttttcagaaacttataaattttacatgtgttaatttctaccaaatttttgatgtttgagactataacaggcataacttacattccaataaatactcacatcacagcaaattgatgtctacctgttgatgatcttaaaaacaaataatacaaggagagttttctattgaag

SEQ ID NO: 362159 - DNA, 425 bp, Homo sapiens
agaattgcttgaacccaggaggcggaggttgcagtgagctgagatggtgccactgtacttcagcctgggcgacaagagcaaaactccatctcaaaaataaataagaaaaataaataaataaatttcattcctctgcccactgccagtatccagccccgctgatgaggctggggtgaggtggggggtaactttttagcacctgggcccttacgtccagcagggctgtgaacagggactttttgtgccagtaacagtagaaaatacggcaactggtgtttgccactatcaaagaggaacttggagttttgttgaaggagcaaaattgtaaccacccaaggggttcaccttgcctgctgcctcgacagagccgattgatcaagacaggggaattgcaatagaagaagagtaattcacgcagagccggc

SEQ ID NO: 362160 - DNA, 521 bp, Homo sapiens
agccctgagccgatgctgcctctggccgccactcaccgtccgctcacgcccagggatgcaggcgatccccaacctggcagtgggtctgtctgttgccctgtgctgcgcggtgcactctctccccctcggatctccttgtggagggtgggttgctcctgctgcccctcccatcacccatctctctgagctgcattatttttagggttataggattttctgggtgtctgatgtcatcagcaacccctactgttcgccagaactttcatgggcacgagcattcacacacacacacactcctcctcaatttctaacgctgaaaccatggtttttttttttttttttgagacagagtctcgctctgtcacccaggctggagtgcagtggtgtgatctcggctcactgcaacctccacctcccgggttcaagtgattctcctgcctcagcctcccgagtagctgggactacagcttacgcagcccagtcccatgtcccgccatccctcaccattgtcgagggtgacc

SEQ ID NO: 362161 - DNA, 367 bp, Homo sapiens
gattcttccccgacagagtcaccctgggattcctcagagcaagtgctccggtcgcattccagatcatccactggcaaaagcatcacttcttacacgtggttttcagggaagtacctaatgcagaacgcaagggtggggtggcaggagcgaggcttgcagcctctacctccttggttcaagtgattctcctgcctcagtctcccaagtagctgggattacaggcacccaccaccacgcccggctagtttttgtatttttagtagagacggggtttcgccatgttggccaggctggtctcgaactcctgacctcaagtgatctgcccaccttggcctcccaaagtgctgggattacaggcatgagccac

SEQ ID NO: 362162 - DNA, 501 bp, Homo sapiens
tcgcttgttggtcgtctctcaggatcccattttatctgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccttcagataaaatgggctgctatgattcatttttataagaaactatcaaactgttttccaaagtggctgtaccattttgaattcccgctatgagtatcccagcgtgccttgcatattcacaaccttgaggtaatggcagttttgtggatctgggccagtctggtggggcagcattcagataaaaggggatccttagagtc

SEQ ID NO: 362163 - DNA, 539 bp, Homo sapiens
gtgggataaagcaccatgctttgtaacagcatcggggtcgttgcaggaccccctgattacaataaagcgagaaagaagaactcctgacttaaaaacatgatattccttcagtgtaggaagcagcagtgaggttgtaataaaggctgcattcaagaagacccatctgaacagctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttaagtgaattagcagtttcattgacttgtaggcaacttggtgaagtgtggtgagttttaatcacattatttaatcagttaaaatttgtaagggctcgcttaacatacaacatgtctgagatgatagtctttca

SEQ ID NO: 362164 - DNA, 441 bp, Homo sapiens
ggcatggtggcatgttgcctctaatcccagccacttgggaggctgaggcaggtgaatctcttgaacccgggaggcggaggttgcattgattccaagatcacgccactgcactccagcctgggtgacagagcgagactctgtctcaaaggaaaaaaaaaaacaatcatgtcttacaaagaaatagtgaattgactcagtgatagcaattgagccccacacacagtgaaaccagcccaggcctgctgtgggccaggcagcccagcgtgtgcaccagtgaagcagaggctcgagacaaatgctgagtgattttgactttattcaccatactgttcagaacactgcacattaaaatccagaattctgggcctccgtgcacctggccaagaggctcagggtggctgggggctggtggcccagagatgtgtctgacctgtgatcttt

SEQ ID NO: 362165 - DNA, 803 bp, Homo sapiens
tttcttttttctttttttgcagattgctgatttggtcaagatgtaaacatatcgtagagctccagcatgggggctcacgcctgtaatacaaacactttggaaggccaaggtgggagaatcactcaagcccaggagtttaagatcaacctgggcaacaaaggctaccacataaagaatatgacattattaaattcccctgcagttacacagagcagtggctctacagtttcttgttggctgaattaagcatttaaagaaatgtttaagtatttaatacaacatcttcaggtatttgaactaagagagtttcttgggaaatgtgctatttgatagattgagaagtctcccagtgctgttttgctttgtttcatcactcactatttaaatgttaattacaaaaataatacatactcactggaagaaaaatcaaacaaactcaaagcacagaaaaattttaaagcctccttgctcttggtggctttctttctcccaccaatttttggtgacttcaatttttgtgttagaccatttatgttcaaagcatccacatgaaacttaccctctataaggtgctgtgagcaccacagacttgaataccagttcccatgctcaagaagccttcaatcttgttgaggagatagatgaaagaactggcttacaacagagaagtagatgtattaaagagtcagttttcccagcactctgggaggctgaggcaggtggatcacctgaggtctggagttcgagaccagcctgaccaacatggagaaaccccatctctactaaaaatacaaaattagccg

SEQ ID NO: 362166 - DNA, 457 bp, Homo sapiens
agattccgtgggtgtaggaccctctgagccaggtgtgggatatagtctcgtggtgcgccgttttttaagccggtctgaaaagcgcaatattcgggtgggagtgacccgattttcccagattgctgatttggtcaagatgtaaacatatcgtagagctccagcatgggggctcacgcctgtaatacaaacactttggaaggccaaggtgggagaatcactcaagcccaggagtttaagatcaacctgggcaacaaagtaagaccctgtctctacaaaacaataaaaagtaaaaactagccaggcatggagcatatgcctgtggtctcagctagacaggaggctgaggcaggagactgagtctgcagtaagccgtgtttgcaccactgcactctaggcttgggtgatacagcaagatctgtctcaaaaaataaaacaaaaagtacatacattgtaacta

SEQ ID NO: 362167 - DNA, 3765 bp, Homo sapiens
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362168 - DNA, 3789 bp, Homo sapiens
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgacaaaaaaacgtaatcaactcaaaact

SEQ ID NO: 362169 - DNA, 3800 bp, Homo sapiens
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgacaaaaaaattgtgttctgattatggcatcggtccgcc

SEQ ID NO: 362170 - DNA, 6087 bp, Homo sapiens
  misc_feature (4472)..(4472): n is a, c, g, or t
  misc_feature (4519)..(4519): n is a, c, g, or t
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagagtgattactgtagtgattgattgattgattactattaactacaaggtataatttactatcaccttatttaaattttatgaattaatttgaatgttttttacactaactaacttttcccaataaagtccactatgaaaccacgacatccaagagcccaaagtcgtcttctctgccttcaagtcatagatttgcccgcagtatctgtggtgctctgggccctcccggtgtccgtctcttccaggatggggatgcccgggagggaaactgtctgtggctctaggctgcacggctcgtgccaacccatcagggagggccatgcccgttgtcctattgagtgccccaccctgcacccccaccttgggaattcacatgtccattccttgaggttcatgtcaacctcggaggcatccctgtcttcattatagctgacccctctcctgcgtccttctgtcagcatatcccttctgcatccttcccgtcacacatacataccaagctatgatgattgattgatagtggccttcgagatgaaaaccatccttaaccccatgatccttcccagctggcatccccaccctaagcaaggttccctaaagagaagcttgttgacattttctccccttcctcacttacagtcagctgtcaccttgctccctccacctcccctcgtcaaggtgactgccttccactgccagccacactggcaattgtcttgagacctcaccgtgcaagcggcctgggggcgtggcggggaggaggaggaggacaaggactcctgaacgctgctcactcggcttccaggacaccccgctcaggttctgcctgccttactgggggctccttctcctttcctggggctgagaggttgtgtctgtgcccactctcctgagctcagccagaatctcncatgtaaagacatccaaatgccgacttcttctccccagagcctggcntttataactgactgccgcctcacgctccattcggatgtctaatgaatctctcagacttgacctgtccaaactgcttgccacctctactcgccaccgcccacccccacaccctccataccgttttccccacgtcactgcccctcccccccttcctcttgccaaatgcctaaaaataaaaattctgaggtggatctgtagcacaatgggcttctagtgacaaatcaaaattctgatctttaaaatgtatgcacaatttacctgttaccgcctggcctaagccatcctgctgttactgctgtgtagcaagttgcagccaaagcgacctcacacggctcctgaaggtcaagaatctgggagcagctcagctggatggctgtgactcggggtctcatgaagtggccaagatgccagctaaggctgccgtctctgaaggcttgacctggcgaggatttgcttccagactcactcgcgtggctattgacagaaggctcagttccatgccacatggcccgttccacagagcagctcacagcttggtagtagctggcttccccagagcggtatctgcgagcagcgtccagatggaagccatggtgttcccttaaaacctgatatggagggtgattccccatcatgtctgtattctgtgggtcacacagaccaaggccggtccactgtggaaggcaaggacgaggttgccagtgcccggcggtgggtggccacagccagcctccctgccagtgtcccccacagacaagttgtccctgtaagacaggtcagctcaggtcattccgagctcagaccttccaacggcgtccatgtccctcagtaaaagccagagtcctaaaggcctcttgcctgctctggcctcctctcaccattctctgccatcctccatctgcccctggtgtccctgaagtcttgaacatgccgagcacatcctgcctcgtatgcttcctggcctggaatgcacttgccccgggacaccctgtgctggctttagtgtttccttcctgtctcctcaagtcaccttattatcaaaaggactccgacaggctaagtgtggtggctcatgcctgtagtcccagcactcgggaaggccgaggtgggaggatcgcttgagcccaggagttcaggacctgcctgggcaacatggcaaaactttgtctctcttaaaaaaaaaaaaaaaaaaaaaaaaaaagagagaatttggggggggattgggcttggaaaggtttctataacacccattccggttggggcgcgcggggcgccatatgtggttcacgtgggaccctgtgggcaaatcagggtgtggccccaaggagaaactccggggcacgtggactagagggcctggggtttttcaccaaattaaaaaaaacgggcccggggggggggaaacacgcgaagcgcggttccgggaacacaaacctccccagagaaagtggaggtccacaggaggggccacaaaacccgcggggcctcctattcacacacgggggaggtccccaacagaagaagctctcaaattttccacaatttaacccccacaccggcggtgggga

SEQ ID NO: 362171 - DNA, 3836 bp, Homo sapiens
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctgggaactgtgacacctgcggggcactgcaagggctgaaaggctggcctcctcccctttgctggccactcactgggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362172 - DNA, 3733 bp, Homo sapiens
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362173 - DNA, 3413 bp, Homo sapiens
tgaatgatgcatagtacgatgcccggtgttagaagatgtcgagaacgggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362174 - DNA, 3774 bp, Homo sapiens
  misc_feature (3459)..(3459): n is a, c, g, or t
  misc_feature (3465)..(3465): n is a, c, g, or t
  misc_feature (3679)..(3679): n is a, c, g, or t
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctaaaaaaaaaaaaaaatnaaaaanaaaaaaaaaaatcgggggttctaatggggggggcgggacaaaacggggtacatggaatgggcccattgggccatagctggtcttcctgacccagggtttttctttgtgtacaacggtgggcagaaactggcggcgggtcccccctaatagggaggccgaattaaattccggaaaaggccggggttaacccgggcttagatgcttcggaaaaaantatacataacacgaacgcatacctccacacacactccaatcaacacaatccattgccctcacactcaaacacatccgcaatcacaacaacaaaat

SEQ ID NO: 362175 - DNA, 3450 bp, Homo sapiens
gagctcggtaccccacaccacctgagtcggagggaattttgtacttttagaggccaatattagtgtttttcccactatgaagctcctgtgtaattgctgtttaaatgttagaagaccatgcgcaaactcgagagctaagtttgggttgctttttgagtagttgttaacaggaatgaaaattcctaggatgccatcttctttacagacctacattcagaatttttgggttttggggtctttcttattttataggtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362176 - DNA, 3493 bp, Homo sapiens
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctaccagtgtctcgattgcctcattcagcgactggctggggtaccgacgctcg

SEQ ID NO: 362177 - DNA, 3111 bp, Homo sapiens
  misc_feature (50)..(50): n is a, c, g, or t
gaaatatgctttatatacatgatggaatgctattcacctatcaaaagccnaaattctgttctttgccataacatggatgaacctagaggacactgtgttaagtgaaataagccaagcacagaaagataaatgctgcatgatctcaccccatatgtaaaacctaaaaagtatatcccataccagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362178 - DNA, 3726 bp, Homo sapiens
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaagaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362179 - DNA, 3543 bp, Homo sapiens
  misc_feature (3365)..(3365): n is a, c, g, or t
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgnaatgaagagtggtggtgcatgttatgatgactaatgggctgcttctgtatgggtttttttttatgtttgttgtgtgttggttgtgttggtttgtgttgtgttgtttgttgtgttgtgtttttggtgtgtgtttgttttgtgtgtgtgtgtgtttttgttggttgtgtgtgtgggtgtg

SEQ ID NO: 362180 - DNA, 3495 bp, Homo sapiens
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaactctaatttatcatcctgggcgccgctccaccacgccccgctctcgctcactttgttccttctctcttgctcaaaaaaaaacaaacaagaaacaacatccactcgggtttggcgttgtggtgacatggacccccctgccaaaacccgccgatcctctcaattcagagccgg

SEQ ID NO: 362181 - DNA, 2749 bp, Homo sapiens
gctccgtacccgacgctctctctgtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362182 - DNA, 2368 bp, Homo sapiens
ggcttaggtcgaggccggggttaatcggccgaggagaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362183 - DNA, 4075 bp, Homo sapiens
  misc_feature (2869)..(2869): n is a, c, g, or t
  misc_feature (2982)..(2982): n is a, c, g, or t
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcttgcagaccattgccccgatcggcttgcangcaggacctgctggcctacctgcaacgcatcgccctctactgccaccagctgaacatctgcagcaaggtcaaggccgaggtgcagaatctcggcgcgggagcttgtgtctctnggggtggacagcgccatgtcctgatccacggcagccaagcaacgttgatgacatgctgctggctgcagacagctgcaacggcactccatacgctcgcctcctaccaaactaccacaacagctcacacgggctactggccttccgctcacacctctccctgccatgcagctcactgcgacacgactcgcaacggcaaccaagcacgcacacacaacgccccactctggctgcacagcacgcagcacgcaaaccacgcgactggaagaccaacagaaacccacacgcacttacacaccgggcgccagtcctacaagcccacgcacagccacacgctggacacccccagggctcgccccagcggccccctccacccacgaacgctctcacaccacgccctcactcggcggaccatgccccactacttcacacgactccctgtcccccccacggagacctccggtgcccgcaagacacggcacaccgagacgcactgacttatcgcgcgtgaccatcccacttgcaacagctaaattcaagcgtatcgaccttggcatctcatgactcccagcctttccaaaatttgaaaaattattggccattagacattatccaacaccagcattgcaatctacccgttaggaagctttatccgcagtcgatcaggggggtaacaacacctggcgtgcccactggcacctacttggctaacacctccacgccctccgccacagcgccatggccgcatgcaacaagcttttctatccgcacatacggaaaaaccactgtaaccgcgtactctaagaccgcctactgacaccgtgtcaactcacacacttgggccctatcctataacaccacacttggccacagtggcagtggccccgcttaagcctgtatgcgcataaagggccactgaataacatttacaatacaccggggcacagcttggccccttttacaaacatttcctttgtcaacccctcatggcaacgccacaacatccctagtcgaccgtgaccaccattctggccttcaacaacaactagttgtcaccccataagcgcttgcgctgccccgaccatgagccattagt

SEQ ID NO: 362184 - DNA, 1720 bp, Homo sapiens
ggtgagacgcgcttcgaggatattgtgaccgatgagcatgatcgctggcgccagtgctcagaggtcatcctggttcaactgccgcagacaatgccaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362185 - DNA, 1773 bp, Homo sapiens
  misc_feature (19)..(19): n is a, c, g, or t
  misc_feature (22)..(22): n is a, c, g, or t
acggctaggtacgaggctnggngttgaatcggccgaggctggtatatgatggcatccgggacatcaggaaagcagtgctgatgataaggacccctgaggagttggatgactctgactttgagacagaagattttgatgtcagaagcaggacgagcgtccagacagaagacgatcagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362186 - DNA, 2441 bp, Homo sapiens
  misc_feature (2438)..(2438): n is a, c, g, or t
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccatcgcttgcagcaggactgtggctactgacgatgnctt

SEQ ID NO: 362187 - DNA, 1953 bp, Homo sapiens
gtcagtctaagtccgcgtgaaagccctcctgctcggcacctgcacagcctctggctgacactgacctttatcgccattgcttaccgcttgtgattgtagtggcatcggtgcgagattaggaatacttagcatgttgaattaggagccctgtaggattcggttgtgaccgggtttgatacacatgatttggatttgtccgatagcacgtttgacgtgtcacatgtctcatgtacgatcggctctaccgctgtgcaagtgcctgtgcgaactctgagtatcttgtgttcccctgtatcttcatccctaaaatctagcggtgcagcaacgtgtggtgtcccccttctgcgaatgctagagcagtctaggagtagacgggactgttcgctccaatttcgatgtgagtgtgtgatgtttcattgtagacttagagactcgtctcctagtgtcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362188 - DNA, 1328 bp, Homo sapiens
aagttcggcacgacggtgcacgcagcatgaacagtctgcagcagaggtcaaggccagaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362189 - DNA, 1345 bp, Homo sapiens
ctagctccccgcggagattctgcaccccggccttgaccttgctgctgatgttcagctggtggcagtagagggcgatgcgttgcaggtaggccagcaggtcctgcttgcaagccgagtcggggcaatggtctgcaatggtgcggccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362190 - DNA, 1650 bp, Homo sapiens
  misc_feature (19)..(19): n is a, c, g, or t
  misc_feature (22)..(22): n is a, c, g, or t
acggctaggtacgaggctnggngttgaatcggccgaggcgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362191 - DNA, 1519 bp, Homo sapiens
  misc_feature (19)..(19): n is a, c, g, or t
  misc_feature (22)..(22): n is a, c, g, or t
acggctaggtacgaggctnggngttgaatcggccgaggcgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttaagtgaattagcagtttcattgacttgtaggcaacttggtgaagtgtggtgagttttaatcacattatttaatcagttaaaatttgtaagggctcgcttaacatacaacatgtctgagatgatagtctttca

SEQ ID NO: 362192 - DNA, 1100 bp, Homo sapiens
  misc_feature (19)..(19): n is a, c, g, or t
  misc_feature (22)..(22): n is a, c, g, or t
acggctaggtacgaggctnggngttgaatcggccgaggcgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttcgtggctgcccacgaagtgggggttcgggaaacgcaactcagcagcaaggtggtacagaagttggtcctgcccttggcggcgaactgaactacctgcccctggaaacagcaggtttatgccctggcttgagaggatccgggctcgggaagcagggggtgcaccccttggctacagtcaaccatctggatgtcactgtgccaaactggggtgcctgcccttaagagccctgcacttcggggggcaag

SEQ ID NO: 362193 - DNA, 1074 bp, Homo sapiens
  misc_feature (19)..(19): n is a, c, g, or t
  misc_feature (22)..(22): n is a, c, g, or t
acggctaggtacgaggctnggngttgaatcggccgaggcgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggcta

SEQ ID NO: 362194 - DNA, 957 bp, Homo sapiens
  misc_feature (46)..(46): n is a, c, g, or t
  misc_feature (642)..(642): n is a, c, g, or t
  misc_feature (648)..(648): n is a, c, g, or t
  misc_feature (862)..(862): n is a, c, g, or t
ggtcaagtagacgattatttgccagccgccccccaccctgggttcngattcatcatgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctaaaaaaaaaaaaaaatnaaaaanaaaaaaaaaaatcgggggttctaatggggggggcgggacaaaacggggtacatggaatgggcccattgggccatagctggtcttcctgacccagggtttttctttgtgtacaacggtgggcagaaactggcggcgggtcccccctaatagggaggccgaattaaattccggaaaaggccggggttaacccgggcttagatgcttcggaaaaaantatacataacacgaacgcatacctccacacacactccaatcaacacaatccattgccctcacactcaaacacatccgcaatcacaacaacaaaat

SEQ ID NO: 362195 - DNA, 863 bp, Homo sapiens
  misc_feature (19)..(19): n is a, c, g, or t
  misc_feature (22)..(22): n is a, c, g, or t
acggctaggtacgaggctnggngttgaatcggccgaggcgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccttcagataaaatgggctgctatgattcatttttataagaaactatcaaactgttttccaaagtggctgtaccattttgaattcccgctatgagtatcccagcgtgccttgcatattcacaaccttgaggtaatggcagttttgtggatctgggccagtctggtggggcagcattcagataaaaggggatccttagagtc

SEQ ID NO: 362196 - DNA, 1168 bp, Homo sapiens
  misc_feature (19)..(19): n is a, c, g, or t
  misc_feature (22)..(22): n is a, c, g, or t
acggctaggtacgaggctnggngttgaatcggccgaggcgtctgcttcgggcctctggaatttagcgctcgcccagctagccgccagattgctgatttggtcaagatgtaaacatatcgtagagctccagcatgggggctcacgcctgtaatacaaacactttggaaggccaaggtgggagaatcactcaagcccaggagtttaagatcaacctgggcaacaaaatcaggccaagcaattctggccattgggacgtccattatactgctcacctggaaaaggcagcgcccagcacaaacgcagcatactccttcacgaggggctctgtgctgttcagcccattgatcaccacttgaagaccaccaaaggaaagcaggttgactgcatctgaagacattcatgataaaatatgcaagaaaatcgctctcccaaaggtttctgtctaagcctgtgctactggctagtggctatgtatcagacagtgcagaacatttctatcattacataaagttctattcaacagcattggtctaggctatcatttaagctccaaatccccaagtccggattctctcttttactctatagcggatctcattacccacagtttattagtaccctggaacaagacaactcgctttcctcagaaaggtcactggatcctgttttctacatgtacccgctacagtctccctcgaatatatctttgttgccacaaaggctgcatcttgcccatatgctaatcccacgctatcaatcatgaggaaaactcaggaagctgaagcccaacaactgtggctgctacccatctttctcctccagattccacagggccccttcccaactgcatccttgcctctctgaactaggagaggactctgacagagaaatcaagtgtgaggattggtatttgactgtgctagtgttttgtggtggcctagcctgttgttgccacttgaaaaatcatattcatacacatttggatggaatctccatgacagcaggggttttgtctgtctgtccacgcttgtagctccagggactaggatggtgctgagcatatggttaggtgttcaatgaataactgttgcattaatgagtatgaatttgatcagaaaagaatgttcctgaaataaagctccagtgtgaataaaaaggcaatctgggg

SEQ ID NO: 362197 - DNA, 890 bp, Homo sapiens
  misc_feature (19)..(19): n is a, c, g, or t
  misc_feature (22)..(22): n is a, c, g, or t
acggctaggtacgaggctnggngttgaatcggccgaggcgtctgcttcgggcctctggaatttagcgctcgcccagctagccgccagattgctgatttggtcaagatgtaaacatatcgtagagctccagcatgggggctcacgcctgtaatacaaacactttggaaggccaaggtgggagaatcactcaagcccaggagtttaagatcaacctgggcaacaaaaatttctctcactttcttacagggctaccacataaagaatatgacattattaaattcccctgcagttacacagagcagtggctctacagtttcttgttggctgaattaagcatttaaagaaatgtttaagtatttaatacaacatcttcaggtatttgaactaagagagtttcttgggaaatgtgctatttgatagattgagaagtctcccagtgctgttttgctttgtttcatcactcactatttaaatgttaattacaaaaataatacatactcactggaagaaaaatcaaacaaactcaaagcacagaaaaattttaaagcctccttgctcttggtggctttctttctcccaccaatttttggtgacttcaatttttgtgttagaccatttatgttcaaagcatccacatgaaacttaccctctataaggtgctgtgagcaccacagacttgaataccagttcccatgctcaagaagccttcaatcttgttgaggagatagatgaaagaactggcttacaacagagaagtagatgtattaaagagtcagttttcccagcactctgggaggctgaggcaggtggatcacctgaggtctggagttcgagaccagcctgaccaacatggagaaaccccatctctactaaaaatacaaaattagccg

SEQ ID NO: 362198 - DNA, 767 bp, Homo sapiens
  misc_feature (19)..(19): n is a, c, g, or t
  misc_feature (22)..(22): n is a, c, g, or t
acggctaggtacgaggctnggngttgaatcggccgaggcgtctgcttcgggcctctggaatttagcgctcgcccagctagccgcagagacagagtttcaccgtgtttcccaggctggtctcaaactcctgagctcaagtgatccacctgccttggcctcccaaagagctgagattacaggcgtgacccactgcgcctggcccactttgaagtcctaaagaaatttaggttattattctatgcatgttggaggatttaagtcttattagcagcttctgttttctgtaaggaaaaagttaaaacacatctggaagagtctcatagagcagcactttctgaaacttgcctgggtaccagtatgcctgcttccagaccttgaagatattacatgtactgcttggtgatctgccctgtcccccacatgttgtgggcctggattgaatggactgaacagtgtggggaattagtccagcgtgacttgccttgtctcatgctgtttgctcacttgtgagagcactatactgaattatccattattgaaagttccaagtgtgcaaagaaccacacttcaaaaataaaatgtcaacattgccctttctctgttagagccttaaatgttcattattttctttagtttttttttataactatcaaacttatttttctccatgtggaagtatgccacaactccatttctaatggagcttgaaattagcatgtatttccacttacttgttgatgggctgtcatcgatcaacccctcttttt

SEQ ID NO: 362199 - DNA, 426 bp, Homo sapiens
  misc_feature (19)..(19): n is a, c, g, or t
  misc_feature (22)..(22): n is a, c, g, or t
acggctaggtacgaggctnggngttgaatcggccgaggcgtctgcttcgggcctctggaatttagcgctcgcccagctagccgccagattgctgatttggtcaagatgtaaacatatcgtagagctccagcatgggggctcacgcctgtaatacaaacactttggaaggccaaggtgggagaatcactcaagcccaggagtttaagatcaacctgggcaacaaagtaagaccctgtctctacaaaacaataaaaagtaaaaactagccaggcatggagcatatgcctgtggtctcagctagacaggaggctgaggcaggagactgagtctgcagtaagccgtgtttgcaccactgcactctaggcttgggtgatacagcaagatctgtctcaaaaaataaaacaaaaagtacatacattgtaacta

SEQ ID NO: 362200 - DNA, 442 bp, Homo sapiens
accagggtggaggaggaggagaactggcatatgcactcaataactttgacgtaagttatgcttgggtggaaatttccagctcttgaccatcccccaaaagataacagatttctggggaaaagtgatcaaggcttctgatgatagctcaatttccacttagatctttaatctaagtcaaaagaaattatgaatcatcagtctacttgattttaacttggcctaaaacatttatttttatttttgtttttagtttgaattaaacttctggattcttttatgtagcttgtgtttcctatgaggtcattctttactgaggatatgggtttggttcatttcaaccaagattttgaccttctggcagatgtgaagctatggtagatacagaaactaagtacacgtagggtcagccccctagaggctcgtggtctattgggagatagag

SEQ ID NO: 362201 - DNA, 366 bp, Homo sapiens
catgaaatatacaaagtttggattatttttatatttttaaaaatgtagatcagttatttgagttcattcttgctgagtttgtttttcattctgtaaaacaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtaagtatacaggcctatgtctgtaatttgttctatcacaggaagattgctactggccttccttagttcagtattccttaggatttagtttggttttg

SEQ ID NO: 362202 - DNA, 205 bp, Homo sapiens
caactgctttttttcttgctttactttactcacttgtcttccacctcagcctgcagtgagtggcttttgtcatcaggcattaataacgcaaagtgcctcagagcagaagagttaactatttgtttacttagctaaaaacatctggacttttctccatagccaggctcctgcttgctgagccggcttgttctcacctcgaggggca

SEQ ID NO: 362203 - DNA, 356 bp, Homo sapiens
cctatccgcataaacacctgccctgggaaagtgtgctgtgcagaaactccaagtcctgtcccagtctctggagaccaaggtctgtccatcatctgttccctgtaggaactgtgacacctgcggggcactgcaagggctgaaaggctggcctcctcccctttgctggccactcactgggtaggaatttttaaaaatcttccttgggaccgggcgtggtggcaggtacctgtaagtcccagctacttgggaggctgagacacaataattacttgagcctgggagatggaggttgcagtgagccgagatggcaccactgcactcccgtctgggcaacagaacaagactgtctcaaaaca

SEQ ID NO: 362204 - DNA, 427 bp, Homo sapiens
cagaacactgcacattaaaatccagaattctgggcctccgtgcacctggccaagaggctcagggtggctgggggctggtggcccagagatgtgtctgacctgtgatctttgtctgggtggcagacccctgaggagttggatgactctgactttgagacagaagattttgatgtcagaagcaggacgagcgtccagacagaagacgatcagctgatagctggccagagtgcccgggtaaggaagcgctccgtggggcagttcagcttgtgctgccgactttccctgtcccctttcttgtttccaggaaaacaccctcagtattcagaacaccgtttctctctctctgtctctctggcagtagactgaagttaaactaagttgtggcacctgctagtcaaatgtagcctcctcagctagaggcagacca

SEQ ID NO: 362205 - DNA, 571 bp, Homo sapiens
ttttaaaaacctggaatgaagattgttattcttgggggtgataacaggtttagtttctgtctctgtcactagtcactggtctctccaatgaagtatatgtaaaactttcagcactgtggctggcaccaagcaaacaataaatgatagatgccagcttacagttgccaccttttcatagaaagcctccttcctcattcaactttttgcttgttctccagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacaggtacgggaactctccctttccagtgctcgcacacaccgcagcctcagtgaggcaggccaccccattagcccagccctgtggtgaggaaggaggagttgggaactcagatttggtctcatggcacatcgggctcctgagaagctggtcatagc

SEQ ID NO: 362206 - DNA, 3443 bp, Homo sapiens
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggcta

SEQ ID NO: 362207 - DNA, 3754 bp, Homo sapiens
  misc_feature (19)..(19): n is a, c, g, or t
  misc_feature (22)..(22): n is a, c, g, or t
acggctaggtacgaggctnggngttgaatcggccgaggcgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362208 - DNA, 6141 bp, Homo sapiens
  misc_feature (4526)..(4526): n is a, c, g, or t
  misc_feature (4573)..(4573): n is a, c, g, or t
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgacatccaagagcccaaagtcgtcttctctgccttcaagtcatagatttgcccgcagtatctgtggtgctctgggccctcccggtgtccgtctcttccaggatggggatgcccgggagggaaactgtctgtggctctaggctgcacggctcgtgccaacccatcagggagggccatgcccgttgtcctattgagtgccccaccctgcacccccaccttgggaattcacatgtccattccttgaggttcatgtcaacctcggaggcatccctgtcttcattatagctgacccctctcctgcgtccttctgtcagcatatcccttctgcatccttcccgtcacacatacataccaagctatgatgattgattgatagtggccttcgagatgaaaaccatccttaaccccatgatccttcccagctggcatccccaccctaagcaaggttccctaaagagaagcttgttgacattttctccccttcctcacttacagtcagctgtcaccttgctccctccacctcccctcgtcaaggtgactgccttccactgccagccacactggcaattgtcttgagacctcaccgtgcaagcggcctgggggcgtggcggggaggaggaggaggacaaggactcctgaacgctgctcactcggcttccaggacaccccgctcaggttctgcctgccttactgggggctccttctcctttcctggggctgagaggttgtgtctgtgcccactctcctgagctcagccagaatctcncatgtaaagacatccaaatgccgacttcttctccccagagcctggcntttataactgactgccgcctcacgctccattcggatgtctaatgaatctctcagacttgacctgtccaaactgcttgccacctctactcgccaccgcccacccccacaccctccataccgttttccccacgtcactgcccctcccccccttcctcttgccaaatgcctaaaaataaaaattctgaggtggatctgtagcacaatgggcttctagtgacaaatcaaaattctgatctttaaaatgtatgcacaatttacctgttaccgcctggcctaagccatcctgctgttactgctgtgtagcaagttgcagccaaagcgacctcacacggctcctgaaggtcaagaatctgggagcagctcagctggatggctgtgactcggggtctcatgaagtggccaagatgccagctaaggctgccgtctctgaaggcttgacctggcgaggatttgcttccagactcactcgcgtggctattgacagaaggctcagttccatgccacatggcccgttccacagagcagctcacagcttggtagtagctggcttccccagagcggtatctgcgagcagcgtccagatggaagccatggtgttcccttaaaacctgatatggagggtgattccccatcatgtctgtattctgtgggtcacacagaccaaggccggtccactgtggaaggcaaggacgaggttgccagtgcccggcggtgggtggccacagccagcctccctgccagtgtcccccacagacaagttgtccctgtaagacaggtcagctcaggtcattccgagctcagaccttccaacggcgtccatgtccctcagtaaaagccagagtcctaaaggcctcttgcctgctctggcctcctctcaccattctctgccatcctccatctgcccctggtgtccctgaagtcttgaacatgccgagcacatcctgcctcgtatgcttcctggcctggaatgcacttgccccgggacaccctgtgctggctttagtgtttccttcctgtctcctcaagtcaccttattatcaaaaggactccgacaggctaagtgtggtggctcatgcctgtagtcccagcactcgggaaggccgaggtgggaggatcgcttgagcccaggagttcaggacctgcctgggcaacatggcaaaactttgtctctcttaaaaaaaaaaaaaaaaaaaaaaaaaaagagagaatttggggggggattgggcttggaaaggtttctataacacccattccggttggggcgcgcggggcgccatatgtggttcacgtgggaccctgtgggcaaatcagggtgtggccccaaggagaaactccggggcacgtggactagagggcctggggtttttcaccaaattaaaaaaaacgggcccggggggggggaaacacgcgaagcgcggttccgggaacacaaacctccccagagaaagtggaggtccacaggaggggccacaaaacccgcggggcctcctattcacacacgggggaggtccccaacagaagaagctctcaaattttccacaatttaacccccacaccggcggtgggga
